United States Patent
Shu et al.

(10) Patent No.: US 12,534,726 B2
(45) Date of Patent: *Jan. 27, 2026

(54) COMPOSITION AND METHOD FOR INHIBITING ANGIOTENSINOGEN (AGT) PROTEIN EXPRESSION

(71) Applicant: Shanghai Argo Biopharmaceutical Co., Ltd., Shanghai (CN)

(72) Inventors: Dongxu Shu, Ningbo (CN); Pengcheng Patrick Shao, Warrington Township, PA (US)

(73) Assignee: Shanghai Argo Biopharmaceutical Co., Ltd., Shanghai (CN)

( * ) Notice: Subject to any disclaimer, the term of this patent is extended or adjusted under 35 U.S.C. 154(b) by 0 days.

This patent is subject to a terminal disclaimer.

(21) Appl. No.: 19/084,507

(22) Filed: Mar. 19, 2025

(65) Prior Publication Data

US 2025/0215429 A1 Jul. 3, 2025

Related U.S. Application Data

(63) Continuation of application No. 18/473,829, filed on Sep. 25, 2023, which is a continuation of application No. PCT/CN2022/131861, filed on Nov. 15, 2022.

(30) Foreign Application Priority Data

| Nov. 16, 2021 | (WO) | ................ | PCT/CN2021/130832 |
| Mar. 18, 2022 | (WO) | ................ | PCT/CN2022/081578 |

(51) Int. Cl.
| C12N 15/113 | (2010.01) |
| A61K 9/00 | (2006.01) |
| A61K 45/06 | (2006.01) |
| A61K 47/54 | (2017.01) |
| A61P 9/12 | (2006.01) |

(52) U.S. Cl.
CPC .......... *C12N 15/113* (2013.01); *A61K 9/0019* (2013.01); *A61K 45/06* (2013.01); *A61K 47/549* (2017.08); *A61P 9/12* (2018.01)

(58) Field of Classification Search
CPC ........ C12N 15/113; A61K 47/549; A61P 9/12
See application file for complete search history.

(56) References Cited

U.S. PATENT DOCUMENTS

| 3,854,480 A | 12/1974 | Zaffaroni |
| 4,452,775 A | 6/1984 | Kent |
| 4,675,189 A | 6/1987 | Kent et al. |
| 5,075,109 A | 12/1991 | Tice et al. |
| 5,133,974 A | 7/1992 | Paradissis et al. |
| 5,211,657 A | 5/1993 | Yamada et al. |
| 5,407,686 A | 4/1995 | Patel et al. |
| 5,736,152 A | 4/1998 | Dunn |
| 7,691,997 B2 | 4/2010 | Khvorova et al. |
| 8,273,866 B2 | 9/2012 | Mcswiggen et al. |
| 8,349,809 B2 | 1/2013 | Brown |
| 8,513,207 B2 | 8/2013 | Brown |
| 8,546,350 B2 | 10/2013 | Bennett et al. |
| 8,618,277 B2 | 12/2013 | Beigelman et al. |
| 8,927,705 B2 | 1/2015 | Brown |
| 9,260,471 B2 | 2/2016 | Cancilla et al. |
| 9,809,819 B2 | 11/2017 | Brown |
| 9,970,005 B2 | 5/2018 | Cancilla et al. |
| 10,131,912 B2 | 11/2018 | Brown |
| 10,233,448 B2 | 3/2019 | Maier et al. |
| 10,238,749 B2 | 3/2019 | Foster et al. |
| 10,752,899 B2 | 8/2020 | Brown |
| 10,837,013 B2 | 11/2020 | Brown |
| 10,870,849 B2 | 12/2020 | Brown |
| 11,015,198 B2 | 5/2021 | Hauptmann et al. |
| 11,193,126 B2 | 12/2021 | Cancilla et al. |
| 11,319,537 B2 | 5/2022 | Dames et al. |
| 11,359,198 B2 | 6/2022 | Brown |
| 11,408,003 B2 | 8/2022 | Brown |
| 11,414,664 B2 | 8/2022 | Brown |
| 11,447,777 B2 | 9/2022 | Brown |
| 11,504,391 B1 | 11/2022 | Schlegel et al. |
| 11,549,110 B2 | 1/2023 | Beigelman et al. |
| 11,597,929 B2 | 3/2023 | Brown |

(Continued)

FOREIGN PATENT DOCUMENTS

| CN | 101292034 A | 10/2008 |
| CN | 102260673 A | 11/2011 |

(Continued)

OTHER PUBLICATIONS

Duschmale et al., Nov. 22, 2019, vol. 48, No. 1, p. 63-74 (Year: 2019).*
Flamme et al., Jul. 1, 2021, Bioorganic & Medicinal Chemistry Letters, 48, 128242, p. 1-5 (Year: 2021).*
Ui-Tei et al., 2004, Nucleic Acids Research, vol. 32, No. 3, p. 936-948 (Year: 2004).*
Wooddell et al., Jun. 18, 2020, JCI Insight, 5(12):e135348 and Supplementary Materials (Year: 2020).*
ACTRN12622001430729p. "A Phase I, Multicenter, Randomized, Double-Blind, Placebo-Controlled, Single Ascending Dose Study to Evaluate the Safety, Tolerability, Pharmacokinetics, and Pharmacodynamics of Subcutaneously Administered BW-00163 in Subjects with Hypertension." Australian New Zealand Clinical Trials Registry (ANZCTR). Date registered: Nov. 8, 2022. URL: https://www.anzctr.org.au/Trial/Registration/TrialReview.aspx?id=384880&isReview=true (6 pages).

(Continued)

*Primary Examiner* — Soren Harward
*Assistant Examiner* — Jenna L Persons
(74) *Attorney, Agent, or Firm* — Finnegan, Henderson Farabow, Garrett & Dunner, LLP

(57) ABSTRACT

Provided are a composition and method for inhibiting angiotensinogen (AGT) protein expression. Specifically, provided are a composition and method capable of being used for reducing AGT gene expression and treating AGT-related diseases and disorders. Provided are an AGT dsRNA reagent capable of being used for reducing AGT expression in a cell and an object, an AGT antisense polynucleotide reagent, a composition containing the AGT dsRNA reagent, and a composition containing the AGT antisense polynucleotide reagent.

10 Claims, 3 Drawing Sheets

Specification includes a Sequence Listing.

(56) References Cited

U.S. PATENT DOCUMENTS

| | | |
|---|---|---|
| 11,634,713 B2 | 4/2023 | Brown |
| 11,932,854 B2 | 3/2024 | Cancilla et al. |
| 12,054,717 B2 | 8/2024 | Dames et al. |
| 12,077,756 B2 | 9/2024 | Brown |
| 12,084,656 B2 | 9/2024 | Hauptmann et al. |
| 12,129,469 B2 | 10/2024 | Beigelman et al. |
| 2005/0255487 A1 | 11/2005 | Khvorova et al. |
| 2006/0217324 A1 | 9/2006 | Soutschek et al. |
| 2008/0113351 A1 | 5/2008 | Naito |
| 2011/0196141 A1 | 8/2011 | Vaijayanti et al. |
| 2014/0186262 A1 | 7/2014 | Wang et al. |
| 2015/0297629 A1 | 10/2015 | Mullick et al. |
| 2016/0333341 A1 | 11/2016 | Bhat |
| 2017/0189441 A1 | 7/2017 | Colletti et al. |
| 2017/0189541 A1 | 7/2017 | Foster et al. |
| 2019/0160090 A1 | 5/2019 | Mullick et al. |
| 2019/0345573 A1 | 11/2019 | Khvorova et al. |
| 2021/0095290 A1 | 4/2021 | Foster et al. |
| 2021/0348168 A1 | 11/2021 | Daugherty et al. |
| 2022/0062427 A1 | 3/2022 | Zhang et al. |
| 2024/0084304 A1 | 3/2024 | Shu et al. |
| 2024/0191236 A1 | 6/2024 | Foster et al. |
| 2025/0257356 A1 | 8/2025 | Shu et al. |

FOREIGN PATENT DOCUMENTS

| | | |
|---|---|---|
| CN | 103103192 A | 5/2013 |
| CN | 106574268 A | 4/2017 |
| CN | 108271351 A | 7/2018 |
| CN | 112313335 A | 2/2021 |
| CN | 113862268 A | 12/2021 |
| CN | 114763547 A | 7/2022 |
| EP | 3366772 A1 | 8/2018 |
| EP | 3812462 A1 | 4/2021 |
| EP | 4029520 A1 | 7/2022 |
| EP | 4403633 A1 | 7/2024 |
| EP | 4421175 A1 | 8/2024 |
| WO | WO 199733623 A1 | 9/1997 |
| WO | WO2003/070918 A2 | 8/2003 |
| WO | WO2003/074654 A2 | 9/2003 |
| WO | WO2004/045543 A2 | 6/2004 |
| WO | WO 2007/031081 A2 | 3/2007 |
| WO | WO2008/137751 A2 | 11/2008 |
| WO | WO2010/080129 A2 | 7/2010 |
| WO | WO2010/111490 A2 | 9/2010 |
| WO | WO2011/038356 A2 | 3/2011 |
| WO | WO2012/058210 A1 | 5/2012 |
| WO | WO2012/145582 A2 | 10/2012 |
| WO | WO2013/074974 A2 | 5/2013 |
| WO | WO2013/177468 A2 | 11/2013 |
| WO | WO2014/130607 A1 | 8/2014 |
| WO | WO2014/179625 A1 | 11/2014 |
| WO | WO2014/179626 A2 | 11/2014 |
| WO | WO2014/179627 A2 | 11/2014 |
| WO | WO2015/168532 A2 | 11/2015 |
| WO | WO 2015179724 A1 | 11/2015 |
| WO | WO2016/028649 A1 | 2/2016 |
| WO | WO2016/057693 A1 | 4/2016 |
| WO | WO2016/100401 A1 | 6/2016 |
| WO | WO2016/149331 A2 | 9/2016 |
| WO | WO 2016/196111 A1 | 12/2016 |
| WO | WO2017/059223 A2 | 4/2017 |
| WO | WO 2017062816 A1 | 4/2017 |
| WO | WO2017/177326 A1 | 10/2017 |
| WO | WO2018/035380 A1 | 2/2018 |
| WO | WO2018/044350 | 3/2018 |
| WO | WO-2018044350 A1 * | 3/2018 ......... A61K 31/7008 |
| WO | WO2018/098328 A1 | 5/2018 |
| WO | WO2018/185241 A1 | 10/2018 |
| WO | WO2019/010342 A1 | 1/2019 |
| WO | WO2019/051402 A1 | 3/2019 |
| WO | WO2019/092283 A1 | 5/2019 |
| WO | WO2019/145543 A1 | 8/2019 |
| WO | WO2019/217397 A2 | 11/2019 |
| WO | WO 2019222166 A1 | 11/2019 |
| WO | WO2020/099476 A1 | 5/2020 |
| WO | WO2020/123410 A1 | 6/2020 |
| WO | WO2020/154342 A1 | 7/2020 |
| WO | WO2020/191183 A1 | 9/2020 |
| WO | WO2020/236526 A1 | 11/2020 |
| WO | WO2021/049504 A1 | 3/2021 |
| WO | WO 2021096763 A1 | 5/2021 |
| WO | WO 2021/119034 A1 | 6/2021 |
| WO | WO2021/178885 A1 | 9/2021 |
| WO | WO2021/234459 A2 | 11/2021 |
| WO | WO2022/028457 A1 | 2/2022 |
| WO | WO2022/032288 A1 | 2/2022 |
| WO | WO2022/079221 A1 | 4/2022 |
| WO | WO2022/159158 A1 | 7/2022 |
| WO | WO2022/162155 A1 | 8/2022 |
| WO | WO 2022232650 A1 | 11/2022 |
| WO | WO 2023278576 A1 | 1/2023 |
| WO | WO 2023014765 A1 | 2/2023 |
| WO | WO2023/041079 A1 | 3/2023 |
| WO | WO 2023/041508 A2 | 3/2023 |
| WO | WO 2023056446 A1 | 4/2023 |
| WO | WO 2023066236 A1 | 4/2023 |
| WO | WO2023/138689 A1 | 7/2023 |
| WO | WO 2023/192630 A2 | 10/2023 |
| WO | WO 2024/013334 A1 | 1/2024 |
| WO | WO 2024/031101 A1 | 2/2024 |
| WO | WO2024/137700 A2 | 6/2024 |
| WO | WO2024/187193 A2 | 9/2024 |

OTHER PUBLICATIONS

ACTRN12623000023651. "A Phase I, Randomized, Double-Blind, Placebo-Controlled, Single Ascending Dose Study to Evaluate the Safety, Tolerability, Pharmacokinetics, and Pharmacodynamics of Subcutaneously Administered BW-00163 in Healthy Subjects and Subjects with Mild Hypertension." Australian New Zealand Clinical Trials Registry (ANZCTR). Date registered: Jan. 10, 2023. URL: https://www.anzctr.org.au/Trial/Registration/TrialReview.aspx?id=385177&isReview=true (6 pages).

Agrawal, Sudhir, et al. "Perspectives in antisense therapeutics." Pharmacology & therapeutics 76.1-3 (1997): 151-160.

Ausin, Cristina, et al. "Time-Dependent Thermocontrol of the Hydrophilic and Lipophilic Properties of DNA Oligonucleotide Prodrugs." Current Protocols in Nucleic Acid Chemistry 43.1 (2010): 4-42.

Bernstein, Emily, et al. "Role for a bidentate ribonuclease in the initiation step of RNA interference." Nature 409.6818 (2001): 363-366.

Campbell, Meghan A. et al. "Locked vs. unlocked nucleic acids (LNA vs. UNA): contrasting structures work towards common therapeutic goals." Chemical Society Reviews 40.12 (2011): 5680-5689.

Czauderna, Frank, et al. "Structural variations and stabilising modifications of synthetic siRNAs in mammalian cells." Nucleic acids research 31.11 (2003): 2705-2716.

Du, Quan, et al. "A systematic analysis of the silencing effects of an active siRNA at all single-nucleotide mismatched target sites." Nucleic acids research 33.5 (2005): 1671-1677.

Elbashir, Sayda M., et al. "RNA interference is mediated by 21- and 22-nucleotide RNAs." Genes & development 15.2 (2001): 188-200.

Elmen, Joacim, et al. "Locked nucleic acid (LNA) mediated improvements in siRNA stability and functionality." Nucleic acids research 33.1 (2005): 439-447.

Englisch, Uwe, et al. "Chemically modified oligonucleotides as probes and inhibitors." Angewandte Chemie International Edition in English 30.6 (1991): 613-629.

Gassmann, Max, et al. "Maintenance of an extrachromosomal plasmid vector in mouse embryonic stem cells." Proceedings of the National Academy of Sciences 92.5 (1995): 1292-1296.

Grunweller, Arnold, et al. "Comparison of different antisense strategies in mammalian cells using locked nucleic acids, 2'-O-methyl RNA, phosphorothioates and small interfering RNA." Nucleic acids research 31.12 (2003): 3185-3193.

(56) References Cited

OTHER PUBLICATIONS

International Search Report and Written Opinion from the International Searching Authority dated Jan. 19, 2023 from corresponding International Patent Application No. PCT/CN2022/131861 filed Nov. 15, 2022.
Janas, Majam., et al. "Selection of GalNAc-conjugated siRNAs with limited off-target-driven rat hepatotoxicity." Nature communications 9.1 (2018): 723.
Kabanov, Alexander V., et al. "A new class of antivirals: antisense oligonucleotides combined with a hydrophobic substituent effectively inhibit influenza virus reproduction and synthesis of virus-specific proteins in MOCK cells." FEBS letters 259.2 (1990): 327-330.
Lam, Jenny KW, et al. "siRNA versus miRNA as therapeutics for gene silencing." Molecular Therapy-Nucleic Acids 4 (2015): 1-20.
Laursen, Maria B., et al. "Utilization of unlocked nucleic acid (UNA) to enhance siRNA performance in vitro and in vivo." Molecular Biosystems 6.5 (2010): 862-870.
Lee, Kyuri, et al. "The cutting-edge technologies of siRNA delivery and their application in clinical trials." Archives of pharmacal research 41 (2018): 867-874.
Letsinger, Robert L., et al. "Cholesteryl-conjugated oligonucleotides: synthesis, properties, and activity as inhibitors of replication of human immunodeficiency virus in cell culture." Proceedings of the National Academy of Sciences 86.17 (1989): 6553-6556.
Manoharan, Muthiah, et al. "Chemical modifications to improve uptake and bioavailability of antisense oligonucleotides." Annals of the New York Academy of Sciences 660.1 (1992): 306-309.
Manoharan, Muthiah, et al. "Cholic acid-oligonucleotide conjugates for antisense applications." Bioorganic & Medicinal Chemistry Letters 4.8 (1994): 1053-1060.
Manoharan, Muthiah, et al. "Introduction of a lipophilic thioether tether in the minor groove of nucleic acids for antisense applications." Bioorganic & Medicinal Chemistry Letters 3.12 (1993): 2765-2770.
Manoharan, Muthiah, et al. "Lipidic nucleic acids." Tetrahedron Letters 36.21 (1995): 3651-3654.
Manoharan, Muthiah, et al. "Oligonucleotide conjugates: alteration of the pharmacokinetic properties of antisense agents." Nucleosides, Nucleotides & Nucleic Acids 14.3-5 (1995): 969-973.
Mishra, Rakesh Kumar, et al. "Improved leishmanicidal effect of phosphorotioate antisense oligonucleotides by LDL-mediated delivery." Biochimica et Biophysica Acta (BBA)—Gene Structure and Expression 1264.2 (1995): 229-237.
Mook, Olaf R., et al. "Evaluation of locked nucleic acid-modified small interfering RNA in vitro and in vivo." Molecular cancer therapeutics 6.3 (2007): 833-843.
Nair, Jayaprakash K., et al. "Multivalent N-acetylgalactosamine-conjugated siRNA localizes in hepatocytes and elicits robust RNAi-mediated gene silencing." Journal of the American Chemical Society 136.49 (2014): 16958-16961.
Nikam, Rah UL R., et al. "Journey of siRNA: clinical developments and targeted delivery." Nucleic acid therapeutics 28.4 (2018): 209-224.
Nykanen, Antti, et al. "ATP requirements and small interfering RNA structure in the RNA interference pathway." Cell 107.3 (2001 ): 309-321.
Oberhauser, Berndt et al. "Effective incorporation of 2'-O-methyl-oligoribonuclectides into liposomes and enhanced cell association through modification with thiocholesterol." Nucleic Acids Research 20.3 (1992): 533-538.
Olearczyk, Jeffrey, et al. "Targeting of hepatic angiotensinogen using chemically modified siRNAs results in significant and sustained blood pressure lowering in a rat model of hypertension." Hypertension Research 37.5 (2014): 405-412.
Reboussin, David M., et al. "Systematic review for the 2017 ACC/AHA/MPA/ABC/ACPM/AGS/APhA/ASH/ASPC/NMA/PCNA guideline for the prevention, detection, evaluation, and management of high blood pressure in adults: a report of the American College of Cardiology/American Heart Association Task Force on Clinical Practice Guidelines." Hypertension 71.6 (2018): e116-e135.
Saison-Behmoaras, T., et al. "Short modified antisense oligonucleotides directed against Ha-ras point mutation induce selective cleavage of the mRNA and inhibit T24 cells proliferation." The EMBO journal 10.5 (1991 ): 1111-1118.
Sawhney, Amarpreet S., et al. "Bioerodible hydrogels based on photopolymerized poly (ethylene glycol)-co-poly (alpha-hydroxy acid) diacrylate macromers." Macromolecules 26.4 (1993): 581-587.
Shea, Regang., et al. "Synthesis, hybridization properties and antiviral activity of lipid-oligodeoxynucleotide conjugates." Nucleic acids research 18.13 (1990): 3777-3783.
Springer, Aaron D., et al. "GalNAc-siRNA conjugates: leading the way for delivery of RNAi therapeutics." Nucleic acid therapeutics 28.3 (2018): 109-118.
Svinarchuk, F. P., et al. "Inhibition of HIV proliferation in MT-4 cells by antisense oligonucleotide conjugated to lipophilic groups." Biochimie 75.1-2 (1993): 49-54.
Uijl, Estrellita, et al. "Strong and sustained antihypertensive effect of small interfering RNA targeting liver angiotensinogen." Hypertension 73.6 (2019): 1249-1257.
Vaish, Narendra et al. "Improved specificity of gene silencing by siRNAs containing unlocked nucleobase analogs." Nucleic acids research 39.5 (2011): 1823-1832.
Whelton, Paulk., et al. "2017 ACC/AHA/MPA/ABC/ACPM/AGS/APhA/ASH/ASPC/NMA/PCNA guideline for the prevention, detection, evaluation, and management of high blood pressure in adults: a report of the American College of Cardiology/American Heart Association Task Force on Clinical Practice Guidelines." Journal of the American College of Cardiology 71.19 (2018): e127-e248.
ACTRN12623001200673. "A Phase 1, Randomized, Double-Blind, Placebo-Controlled, Single Ascending Dose Study to Evaluate the Safety, Tolerability, Pharmacokinetics, and Pharmacodynamics of Subcutaneously Administered BW-20829 in subjects with elevated lipoprotein(a)." Australian New Zealand Clinical Trials Registry (ANZCTR). Date registered: Nov. 21, 2023. URL: https://www.anzctr.org.au/Trial/Registration/TrialReview.aspx?id=386737&isReview=true (6 pages).
Allerson et al. (2005) "Fully 2'-Modified Oligonucleotide Duplexes with Improved in Vitro Potency and Stability Compared to Unmodified Small Interfering RNA" J Med Chem, (48):901-904.
Anderson et al., (2021) "Towards next generation antisense oligonucleotides: mesylphosphoramidate modification improves therapeutic index and duration of effect of gapmer antisense oligonucleotides" Nucleic Acids Research, 49(16):9026-9041.
Beaucage et al., (1992) "Advances in the Synthesis of Oligonucleotides by the Phosphoramidite Approach" Tetrhedron, 48(12): 2223-2311.
Biscans et al., (2019) "Diverse lipid conjugates for functional extra-hepatic siRNA delivery in vivo" Nucleic Acids Research, 47(3):1082-1096.
Cook., (1998) "Chapter 2: Antisense Medicinal Chemistry" Antisense Research and Application,131:51-101.
Crooke et al., (1996) "Pharmacokinetic Properties of Several Novel Oligonucleotide Analogs in Mice" The Journal of Pharmacology and Experimental Therapeutics, 277(2):923-937.
Ding et al., (2014) "Direct Cytosolic siRNA delivery by Reconsitituted High Density Lipoprotein for Target-Specific Therapy of Tumor Angiogenesis" Biomaterials, 35:7214-7227.
Duschmale et al., (2019) "In vitro and in vivo properties of therapeutic oligonucleotides containing non-chiral 3' and 5' thiophosphate linkages" Nucleic Acids Research, 48:63-74.
Elbashir et al., (2001) "RNA interference is mediated by 21- and 22-nucleotide RNAs" Genes & Development, 15:188-200.
Flamme et al., (2021) "Towards the enzymatic synthesis of phosphorothioate containing LNA oligonucleotides" Bioorganic & Medicinal Chemistry Letters, 48(128242):1-5.
Gonzalez-Carmona et al., (2013) "Inhibition of hepatitis C virus RNA translation by antisense bile acid conjugated phosphorothioate modified oligodeoxynucleotides (ODN)" Antiviral Research, 97(1):49-59.

(56) References Cited

OTHER PUBLICATIONS

International Search Report and Written Opinion from the International Searching Authority dated May 8, 2023 from corresponding International Patent Application No. PCT/CN2023/073456 filed on Jan. 23, 2023.

Herdewijn et al., (2008) "Modified Nucleosides: in Biochemistry, Biotechnology and Medicine".

Huang., (2019) "Approval of the first-ever rnai therapeutics and its technological development history" Progress in Biochemistry and Biophysics, 46(3):313-322.

Jayaprakash et al., (2014) "Multivalent N-Acetylgalactosamine-Conjugated siRNA Localizes in Hepatocytes and Elicits Robust RNAi-Mediated Gene Silencing" J. Am. Chem. Soc., 136:16958-16961.

Juliano et al., (2011) "Integrin Targeted Delivery of Gene Therapeutics" Theranostics, 1:211-219.

Knerr et al., (2021) "Glucagon Like Peptide 1 Receptor Agonists for Targeted Delivery of Antisense Oligonucleotides to Pancreatic Beta Cell" J. Am. Chem. Soc., 143:3416-3429.

Liu et al., (2018) "An Investigational RNAi Therapeutic Targeting Factor XII (ALN-F12) for the Treatment of Hereditary Angioedema" RNA, 25:255-263.

Lonnberg et al., (2017) "Synthesis of oligonucleotides on a soluble support" Beilstein J. Org. Chem, 13:1368-1387.

Martin et al., (1995) "A New Access to 2'-O-Alkylated Ribonucleosides and Properties of 2'-O-Alkylated Oligoribonucleotides" Helvetica Chimica Acta, 78(2):486-504.

Office Action in U.S. Appl. No. 19/084,507, mailed May 23, 2025, 26 pages.

Osborn et al., (2018) "Improving Small Interfering RNA Delivery In Vivo Through Lipid Conjugation" Nucleic and Therapeutics, 28(3):1-9.

Pon., (2000) "Solid-phase supports for oligonucleotide synthesis" Current Protocols in Nucleic Acid Chemistry, 3.1.1-3.1.28.

Prakash et al., (2019) "Fatty acid conjugation enhances potency of antisense oligonucleotides in muscle" Nucleic Acids Research, 47(12):6029-6044.

Qian et al., (2002) "Targeted Drug Delivery via the Transferrin Receptor—Mediated Endocytosis Pathway" Pharmacological Reviews,54(4):561-587.

Raouane et al., (2012) "Lipid Conjugated Oligonucleotides: A Useful Strategy for Delivery" Bioconjugate Chemistry, 23:1091-1104.

Rashad et al., (2019) "Chapter 8: Click Chemistry for Cyclic Peptide Drug Design" Cyclic Peptide Design, Methods in Molecular Biology, 133-145.

Sharma et al., (2018) "Novel Cluster and Monomer-Based GalNAc Structures Induce Effective Uptake of siRNAs in Vitro and in Vivo" Bioconjugate Chemistry,29:2478-2488.

Sharp et al., (2001) "RNA interference—2001" Genes Development, 15:485-490.

Tetko et al., (2001) "Prediction of n-Octanol/Water Partition Coefficients from PHYSPROP Database Using Artificial Neural Networks and E-State Indices" J. Chem. Inf. Comput. Sci, 41:1407-1421.

Ui-Tei et al., (2004) "Guidelines for the selection of highly effective siRNA sequences for mammalian and chick RNA interference" Nucleic Acids Research, 32:936-948.

Wooddell et al., (2020) "Development of an RNAi therapeutic for alpha-1-antitrypsin liver disease" JCI Insight, 5(e135348):1-56.

Zhao et al., (2008) "Targeted drug delivery via folate receptors" Expert Opin. Drug Deliv.,5(3):309-319.

U.S. Appl. No. 18/730,467, filed Jan. 23, 2023, by Shu et al.

\* cited by examiner (P<0.001 vs baseline; Two-way ANOVA, Bonferroni posttests)

(** P<0.01; VS. G1 Vehicle, Two-way ANOVA, Bonferroni posttests)

(**P<0.01; VS. G1 Vehicle, Two-way ANOVA, Bonferroni posttest)

(*P<0.05; P<0.01; *P<0.001; VS. G1 Vehicle, Two-way ANOVA, Bonferroni posttests)

COMPOSITION AND METHOD FOR INHIBITING ANGIOTENSINOGEN (AGT) PROTEIN EXPRESSION

RELATED APPLICATIONS

This application is a continuation of U.S. patent application Ser. No. 18/473,829, filed Sep. 25, 2023, which is a continuation of and claims the benefit under 35 U.S.C. § 120 and 36 U.S.C. § 365 (c) to International Application PCT/CN2022/131861, entitled COMPOSITION AND METHOD FOR INHIBITING ANGIOTENSINOGEN (AGT) PROTEIN EXPRESSION, with an international filing date of Nov. 15, 2022, which claims the priority to PCT Application No. PCT/CN2021/130832, entitled COMPOSITION AND METHOD FOR INHIBITING ANGIOTENSINOGEN (AGT) PROTEIN EXPRESSION, filed Nov. 16, 2021 with the China National Intellectual Property Administration, and PCT Application No. PCT/CN2022/081578, entitled COMPOSITION AND METHOD FOR INHIBITING ANGIOTENSINOGEN (AGT) PROTEIN EXPRESSION, filed Mar. 18, 2022 with the China National Intellectual Property Administration, the disclosures of each of which are incorporated herein by reference in their entirety for all purposes.

REFERENCE TO AN ELECTRONIC SEQUENCE LISTING

The contents of the electronic sequence listing (PAT059658-WO-PCT03_SL.xml; Size: (5,321,163 bytes; Date of Creation: Aug. 14, 2024) is herein incorporated by reference in its entirety.

TECHNICAL FIELD

Some of the embodiments of the invention relate to compositions and methods useful for inhibiting the expression of angiotensinogen (AGT) protein.

BACKGROUND ART

The renin-angiotensin-aldosterone system (RAAS) plays a key role in blood pressure regulation. The RAAS cascade begins with the secretion of renin into the circulation by the juxtaglomerular cells of the kidney. Renin secretion is stimulated by several factors, including $Na^+$ loading in the distal tubules, beta-sympathetic stimulation, and/or reduced renal perfusion. Active renin in the plasma splits angiotensinogen (produced by the liver) into angiotensin I, which is subsequently converted to angiotensin II by circulating and locally expressed angiotensin-converting enzyme (ACE). Most of the effects of angiotensin II on the RAAS are exerted through its binding to the angiotensin II type 1 receptor (ATIR), resulting in arterial vasoconstriction, tubular and glomerular effects such as enhanced regulation of $Na^+$ reabsorption or glomerular filtration rate. Further, together with other stimuli (such as corticotropin, antidiuretic hormone, catecholamines, endothelin, and serotonin) as well as $Mg^{2+}$ and $K^+$ levels, ATIR stimulation leads to aldosterone release, which subsequently promotes excretion of $Na^+$ and $K^+$ in the distal tubules.

Dysregulation of the RAAS resulting in, for example, excessive angiotensin II production and/or ATIR stimulation causes hypertension, which can lead to, for example, increased oxidative stress, promotion of inflammation, hypertrophy, and fibrosis in the heart, kidneys, and arteries, and also to, for example, left ventricular fibrosis, arterial remodeling, and glomerulosclerosis.

Hypertension is the most prevalent manageable disease in developed countries, affecting 20-50% of the adult population. Hypertension is a major risk factor for a variety of diseases, disorders, and conditions, such as shortened life expectancy, chronic kidney disease, stroke, myocardial infarction, heart failure, aneurysm (e.g., aortic aneurysm), peripheral artery disease, cardiac injury (for example, cardiac dilation or hypertrophy) and other cardiovascular-related diseases, disorders and/or conditions. Further, hypertension has been shown to be an important risk factor for cardiovascular morbidity and mortality, accounting for or constituting 62% of all strokes and 49% of all heart disease. In 2017, the guidelines for the diagnosis, prevention, and treatment of hypertension were changed to provide even lower blood pressure targets so as to further reduce the risk of developing hypertension-related diseases and disorders (see for example, Reboussin et al., Systematic Review for the 2017ACC/AHA/AAPA/ABC/ACPM/AGS/APhA/ASH/ASPC/NMA/PCNA Guideline for the Prevention, Detection, Evaluation, and Management of High Blood Pressure in Adults: A Report of the American College of Cardiology/American Heart Association Task Force on Clinical Practice Guidelines. *J Am Coll Cardiol.* 2017 Nov. 7. pii: S0735-1097 (17) 41517-8. doi: 10.1016/j.jacc.2017.11.004; and Whelton et al. (2017ACC/AHA/AAPA/ABC/ACPM/AGS/APhA/ASH/ASPC/NMA/PCNA Guideline for the Prevention, Detection, Evaluation, and Management of High Blood Pressure in Adults: A Report of the American College of Cardiology/American Heart Association Task Force on Clinical Practice Guidelines. *J Am Coll Cardiol.* 2017 Nov. 7. pii: S0735-1097 (17) 41519-1.doi: 10.1016/j.jacc.2017.11.006).

Despite the large number of antihypertensive drugs available to treat hypertension, in more than two-thirds of subjects the condition cannot be controlled by one antihypertensive drug, and two or more antihypertensive drugs selected from different drug classes are required. This further reduces the number of subjects with controlled blood pressure due to decreased compliance and increased side effects experienced with greater medication use.

Accordingly, there is a need in the art for alternative and combination therapies for the treatment of hypertension and other angiotensinogen-related diseases.

SUMMARY OF THE INVENTION

According to one aspect of the present invention, there is provided a double-stranded ribonucleic acid (dsRNA) reagent for inhibiting angiotensinogen (AGT) expression, said dsRNA agent comprising a sense strand and an antisense strand, nucleotide positions 2 to 18 in the antisense strand including a region of complementarity to an AGT RNA transcript, wherein the region of complementarity comprises at least 15 contiguous nucleotides that differ by 0, 1, 2, or 3 nucleotides from one of the antisense sequences listed in Tables 1-4, and optionally includes a targeting ligand. In some embodiments, the region of complementarity to the AGT RNA transcript comprises at least 15, 16, 17, 18, or 19 contiguous nucleotides that differ by no more than 3 nucleotides from one of the antisense sequences listed in Tables 1-4. In certain embodiments, the antisense strand of the dsRNA is at least substantially complementary to any target region of SEQ ID NO: 519 and is provided in one of Tables 1-4. In some embodiments, the antisense strand of the dsRNA is fully complementary to any target region of SEQ ID NO: 519 and is provided in one of Tables 1-4. In some embodiments, the dsRNA agent comprises any one of the sense strand sequences listed in Tables 1-4, wherein the sense strand sequence is at least substantially complementary to the antisense strand sequence in the dsRNA agent. In certain embodiments, the dsRNA agent comprises any of the sense strand sequences listed in Tables 1-4, wherein the sense strand sequence is completely complementary to the antisense strand sequence in the dsRNA agent. In some embodiments, the dsRNA agent comprises any of the antisense strand sequences listed in Tables 1-4. In some embodiments, the dsRNA agent comprises any of the sequences listed as duplex sequences in Tables 1-4.

In some embodiments, the dsRNA agent comprises a sense strand that differs by 0, 1, 2, or 3 nucleotides from Formula (A): 5'-$Z_1$AGCUUGUUUGUGAAAC$Z_2$-3' (SEQ ID NO: 656), wherein $Z_1$ is a nucleotide sequence comprising 0-15 nucleotide motifs, and $Z_2$ is selected from one of A, U, C, G or does not exist. In certain embodiments, $Z_1$ is a nucleotide sequence comprising 1-4 nucleotide motifs. In certain embodiments, $Z_1$ is a nucleotide sequence comprising 1, 2, 3, or 4 nucleotide motifs. In certain embodiments, $Z_2$ is A. In certain embodiments, $Z_1$ is a nucleotide sequence comprising a CACC or GACC motif. In certain embodiments, the $Z_1$ nucleotide sequence is selected from one of the following motifs: C, AC, UC, GC, CC, ACC, UCC, GCC, CCC, GACC, AACC, UACC, CACC, CGACC, CCGACC, ACCGACC, AACCGACC, CAACCGACC, CCAACCGACC (SEQ ID NO: 657), UCCAACCGACC (SEQ ID NO: 658), UUCCAACCGACC (SEQ ID NO: 659), AUUCCAACCGACC (SEQ ID NO: 660), AAUUCCAACCGACC (SEQ ID NO: 661) or GAAUUCCAACCGACC (SEQ ID NO: 662). In some embodiments, the dsRNA agent comprises an antisense strand that differs by 0, 1, 2, or 3 nucleotides from Formula (B): 5'-$Z_3$GUUUCACAAACAAGCU$Z_4$-3' (SEQ ID NO: 663), wherein $Z_3$ is selected from one of A, U, C, G or does not exist, and $Z_4$ is a nucleotide sequence comprising 0-15 nucleotide motifs. In certain embodiments, $Z_4$ is a nucleotide sequence comprising 1-4 nucleotide motifs. In certain embodiments, $Z_4$ is a nucleotide sequence comprising 1, 2, 3, or 4 nucleotide motifs. In certain embodiments, $Z_3$ is U. In certain embodiments, the $Z_4$ nucleotide sequence is selected from nucleotide sequences comprising a GGUC or GGUG motif. In certain embodiments, the $Z_4$ nucleotide sequence is selected from one of the following motifs: G, GU, GC, GA, GG, GGU, GGA, GGC, GGG, GGUG, GGUC, GGUU, GGUA, GGUCG, GGUCGG, GGUCGGU, GGUCGGUU, GGUCGGUUG, GGUCGGUUGG (SEQ ID NO: 664), GGUCGGUUGGA (SEQ ID NO: 665), GGUCGGUUGGAA (SEQ ID NO: 666), GGUCGGUUGGAAU (SEQ ID NO: 667), GGUCGGUUGGAAUU (SEQ ID NO: 668) or GGUCGGUUGGAAUUC (SEQ ID NO: 669). In some embodiments, the dsRNA agent comprises a sense strand and an antisense strand, the sense strand and the antisense strand respectively comprising nucleotide sequences that differ by 0, 1, 2, or 3 nucleotides from formula (A) and formula (B) as described herein, and optionally comprising a targeting ligand. In certain embodiments, the sense strand (A) and antisense strand (B) of the dsRNA agent are each no more than 35 nucleotides in length. In certain embodiments, the $Z_1$ and $Z_4$ nucleotide motifs are fully or partially complementary. In some embodiments, the dsRNA agent comprises a sense strand that differs by 0, 1, 2, or 3 nucleotides from formula (A'): 5'—$Z_1$'CAGCUUGUUUGUGAAACA-3' (SEQ ID NO: 670)', and comprises an antisense strand that differs by 0, 1, 2 or 3 nucleotides from formula (B'): 5'-UGUUUCACAAACAAGCUG$Z_4$'-3' (SEQ ID NO: 671), where $Z_1$' and $Z_4$' each independently comprise a nucleotide sequence of 0-13 nucleotide motifs. In certain embodiments, $Z_1$' and $Z_4$' each independently comprise a nucleotide sequence of 1, 2, or 3 nucleotide motifs. In certain embodiments, the $Z_1$' nucleotide sequence is selected from one of the following motifs: A, U, G, C, AC, UC, GC, CC, GAC, AAC, UAC, CAC, CGAC, CCGAC, ACCGAC, AACCGAC, CAACCGAC or GAAUUCCAACCGAC (SEQ ID NO: 672). The $Z_4$' nucleotide sequence is selected from one of the following motifs: U, C, A, G, GU, GA, GC, GG, GUG, GUC, GUU, GUA, GUCG, GUCGG, GUCGGU, GUCGGUU, GUCGGUUG or GUCGGUUGGAAUUC (SEQ ID NO: 673).

In some embodiments, the dsRNA agent comprises a sense strand and an antisense strand, the antisense strand comprising at least 15 contiguous nucleotides that differ by 0, 1, 2, or 3 nucleotides from one of the antisense sequences listed below:

```
                                    (SEQ ID NO: 162)
5'-UACUCAUUAGAAGAAAAGGUG-3';

(SEQ ID NO: 163)
5'-UCUUAGACCAAGGAGAAACGG-3';

(SEQ ID NO: 167)
5'-UGUUUCACAAACAAGCUGGUC-3';

(SEQ ID NO: 523)
5'-UGUUUCACAAACAAGCUGGUG-3';

(SEQ ID NO: 184)
5'-UUCGGUUGGAAUUCUUUUUGC-3';

(SEQ ID NO: 653)
5'-GUUUCACAAACAAGCUGG-3'.
```

In some embodiments, the dsRNA agent comprises a sense strand and an antisense strand, each of which comprises at least 15 contiguous nucleotides that differ by 0, 1, 2, or 3 nucleotides from one of the nucleotide sequences listed below:

```
Sense strand:
                                    (SEQ ID NO: 65)
5'-CACCUUUUCUUCUAAUGAGUA-3', Antisense strand:
                                    (SEQ ID NO: 162)
5'-UACUCAUUAGAAGAAAAGGUG-3'.
```

In some embodiments, the dsRNA agent comprises a sense strand and an antisense strand, each of which comprises at least 15 contiguous nucleotides that differ by 0, 1, 2, or 3 nucleotides from one of the nucleotide sequences listed below:

```
Sense strand:
                                    (SEQ ID NO: 66)
5'-CCGUUUCUCCUUGGUCUAAGA-3', Antisense strand:
                                    (SEQ ID NO: 163)
5'-UCUUAGACCAAGGAGAAACGG-3'.
```

In some embodiments, the dsRNA agent comprises a sense strand and an antisense strand, each of which comprises at least 15 contiguous nucleotides that differ by 0, 1, 2, or 3 nucleotides from one of the nucleotide sequences listed below:

```
Sense strand:
                                        (SEQ ID NO: 70)
5'-GACCAGCUUGUUUGUGAAACA-3', Antisense strand:
                                       (SEQ ID NO: 167)
5'-UGUUUCACAAACAAGCUGGUC-3'.
```

In some embodiments, the dsRNA agent comprises a sense strand and an antisense strand, each of which comprises at least 15 contiguous nucleotides that differ by 0, 1, 2, or 3 nucleotides from one of the nucleotide sequences listed below:

```
Sense strand:
                                       (SEQ ID NO: 522)
5'-CACCAGCUUGUUUGUGAAACA-3'

Antisense strand:
                                       (SEQ ID NO: 523)
5'-UGUUUCACAAACAAGCUGGUG-3';
```

In some embodiments, the dsRNA agent comprises a sense strand and an antisense strand, each of which comprises at least 15 contiguous nucleotides that differ by 0, 1, 2, or 3 nucleotides from one of the nucleotide sequences listed below:

```
Sense strand:
                                        (SEQ ID NO: 87)
5'-GCAAAAAGAAUUCCAACCGAA-3', Antisense strand:
                                       (SEQ ID NO: 184)
5'-UUCGGUUGGAAUUCUUUUUGC-3'.
```

In some embodiments, the dsRNA agent comprises a sense strand and an antisense strand, each of which comprises at least 15 contiguous nucleotides that differ by 0, 1, 2, or 3 nucleotides from one of the nucleotide sequences listed below:

```
Sense strand:
                                       (SEQ ID NO: 652)
5'-CCAGCUUGUUUGUGAAAC-3', Antisense strand:
                                       (SEQ ID NO: 653)
5'-GUUUCACAAACAAGCUGG-3'.
```

In some embodiments, the dsRNA agent duplex is selected from any one duplex of AD00158-19-2, AD00158-19-1, AD00158-3, AD00158-1, AD00158-2, AD00158, AD00159, AD00159-1, AD00159-2, AD00159-19-1, AD00159-19-2, AD00163, AD00163-1, AD00163-2, AD00163-19-1, AD00163-19-2, AD00163-3, AD00300-1, AD00300-19-1 and AD00300-19-2 in Table 1.

In some embodiments, the dsRNA agent duplex is selected from any one duplex of AV01227, AV01228, AV01229, AV01230, AV01231, AV01232, AV01233, AV01234, AV01235, AV01236, AV01237, AV01238, AV01239, AV01240, AV01241, AV01242, AV01243, AV01244, AV01245, AV01246, AV01247, AV01248, AV01249, AV01250, AV01251, AV01252, AV01253, AV01254, AV01255, AV01256, AV01257 or AV01711 in Table 1.

In some embodiments, the dsRNA agent comprises at least one modified nucleotide. In certain embodiments, all or substantially all of the nucleotides of the antisense strand are modified nucleotides. In some embodiments, the at least one modified nucleotide includes 2'-O-methyl nucleotides, 2'-fluoro nucleotides, 2'-deoxy nucleotides, 2',3'-seco nucleotide mimics, locked nucleotides, unlocked nucleic acid (UNA) nucleotides, glycol nucleic acid (GNA) nucleotides, 2'-F-arabinonucleotides, 2'-methoxyethyl nucleotides, abasic nucleotides, ribitol, inverted nucleotides, inverted abasic nucleotides, inverted 2'-OMe nucleotides, inverted 2'-deoxy nucleotides, 2'-amino modified nucleotides, 2'-alkyl modified nucleotides, morpholino nucleotides and 3'-OMe nucleotides, nucleotides including a 5'-phosphorothioate group, or terminal nucleotides linked to a cholesterol derivative or dodecanoic acid bisdecylamide group, 2'-amino modified nucleotides, phosphoramidates or a non-natural base containing nucleotides.

In some embodiments, these double-stranded ribonucleic acid (dsRNA) agents comprise a sense strand and an antisense strand that is complementary to at least a portion of the mRNA corresponding to the target gene, where the dsRNA agent comprises a nucleotide sequence having the antisense strand depicted by formula (C) and a nucleotide sequence having the sense strand depicted by formula (D).

The antisense strand comprises formula (C) listed in the 3' to 5' direction:

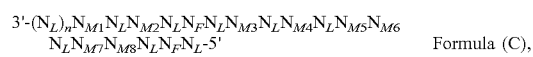

Formula (C), and the sense strand comprises formula (D) listed in the 5' to 3' direction:

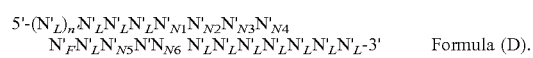

Formula (D).

Wherein, each $N_F$ represents a 2'-fluoro-modified nucleotide. $N_{M1}$, $N_{M2}$, $N_{M3}$, $N_{M4}$, $N_{M5}$, $N_{M6}$, $N_{M7}$ and $N_{M8}$ independently represent modified or unmodified nucleotides. There are only three 2'-fluoro-modified nucleotides or only one 2'-fluoro-modified nucleotide in $N_{M1}$, $N_{M2}$, $N_{M3}$, $N_{M4}$, $N_{M5}$, $N_{M6}$, $N_{M7}$ and $N_{M8}$. Each $N'_L$ independently represents a modified or unmodified nucleotide, where this modification is not a 2'-fluoro-modified nucleotide. Each $N'_F$ represents a 2'-fluoro-modified nucleotide. $N'_{N1}$, $N'_{N2}$, $N'_{N3}$, $N'_{N4}$, $N'_{N5}$ and $N'_{N6}$ independently represent modified or unmodified nucleotides. There are only two 2'-fluoro-modified nucleotides in $N'_{N1}$, $N'_{N2}$, $N'_{N3}$, $N'_{N4}$, $N'_{N5}$ and $N'_{N6}$. Each $N'_L$ independently represents a modified or unmodified nucleotide, where this modification is not a 2'-fluoro-modified nucleotide. Each n and n' may independently be an integer from 0 to 7.

In certain embodiments, the nucleotides at position 2, 7, 12, 14, and 16 (counting from the first paired nucleotide at the 5' end) of the antisense strand represented by formula (C) in the dsRNA agent are 2'-fluorine-modified nucleotides; and the nucleotides at position 9, 11 and 13 (counting from the first paired nucleotide at the 3' end) of the sense strand represented by formula (D) are 2'-fluoro-modified nucleotides. In certain embodiments, the nucleotides at positions $N_{M2}$, $N_{M3}$, $N_{M6}$ of the antisense strand represented by formula (C) are 2'-fluoro-modified nucleotides, and the nucleotides at positions $N'_{N3}$, $N'_{N5}$ of the sense strand represented by formula (D) are 2'-fluoro-modified nucleotides.

In some embodiments, the dsRNA agent comprises an E-vinylphosphonate nucleotide at the 5' end of the guide strand. In certain embodiments, the dsRNA agent comprises at least one phosphorothioate internucleoside linkage. In certain embodiments, the sense strand comprises at least one phosphorothioate internucleoside linkage. In some embodiments, the antisense strand comprises at least one phosphorothioate internucleoside linkage. In some embodiments, the sense strand comprises 1, 2, 3, 4, 5, or 6 phosphorothioate internucleoside linkages. In some embodiments, the antisense strand comprises 1, 2, 3, 4, 5, or 6 phosphorothioate internucleoside linkages.

In certain embodiments, all or substantially all nucleotides of the sense and antisense strands are modified nucleotides. In some embodiments, the modified sense strand is a modified sense strand sequence listed in Tables 2-4. In some embodiments, the modified antisense strand is a modified antisense strand sequence listed in Tables 2-4.

In certain embodiments, the sense strand is complementary or substantially complementary to the antisense strand, and the region of complementarity is between 16 and 23 nucleotides in length. In some embodiments, the region of complementarity is 19-21 nucleotides in length. In certain embodiments, the region of complementarity is 14, 15, 16, 17, 18, 19, 20, 21, 22, 23, 24, 25, 26, 27, 28, 29, or 30 nucleotides in length.

In some embodiments, the length of each strand is no more than 40 nucleotides. In some embodiments, each strand is no more than 30 nucleotides in length. In some embodiments, each strand is no more than 25 nucleotides in length. In some embodiments, each strand is no more than 23 nucleotides in length. In some embodiments, each strand is 4, 15, 16, 17, 18, 19, 20, 21, 22, 23, 24, 25, 26, 27, 28, 29, or 30 nucleotides in length.

In certain embodiments, the dsRNA agent comprises at least one modified nucleotide and further comprises one or more targeting or linking groups. In some embodiments, one or more targeting groups or linking groups are conjugated to the sense strand. In some embodiments, the targeting group or linking group includes N-acetyl-galactosamine (GalNAc). In some embodiments, the targeting group has the following structure:

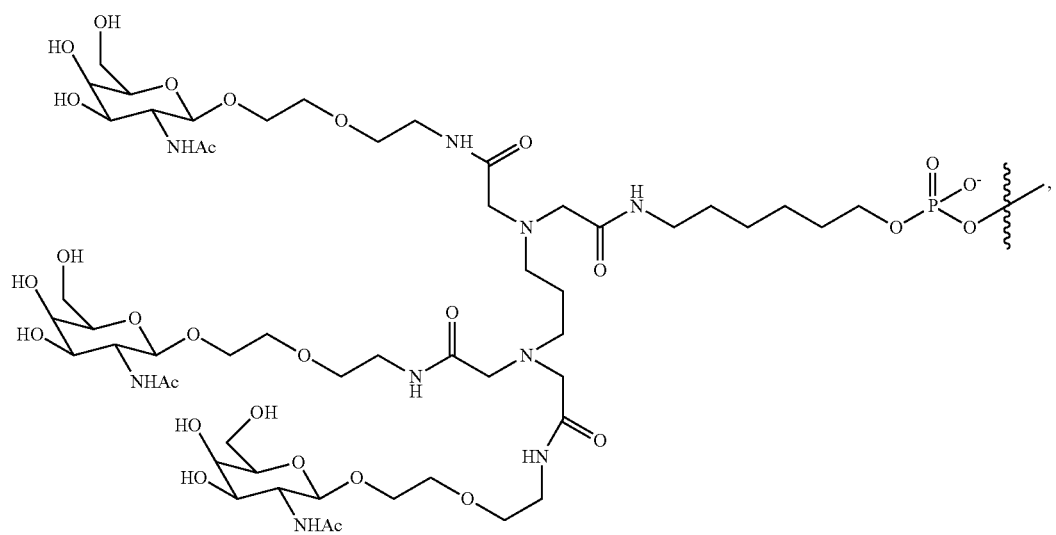

GLO-1

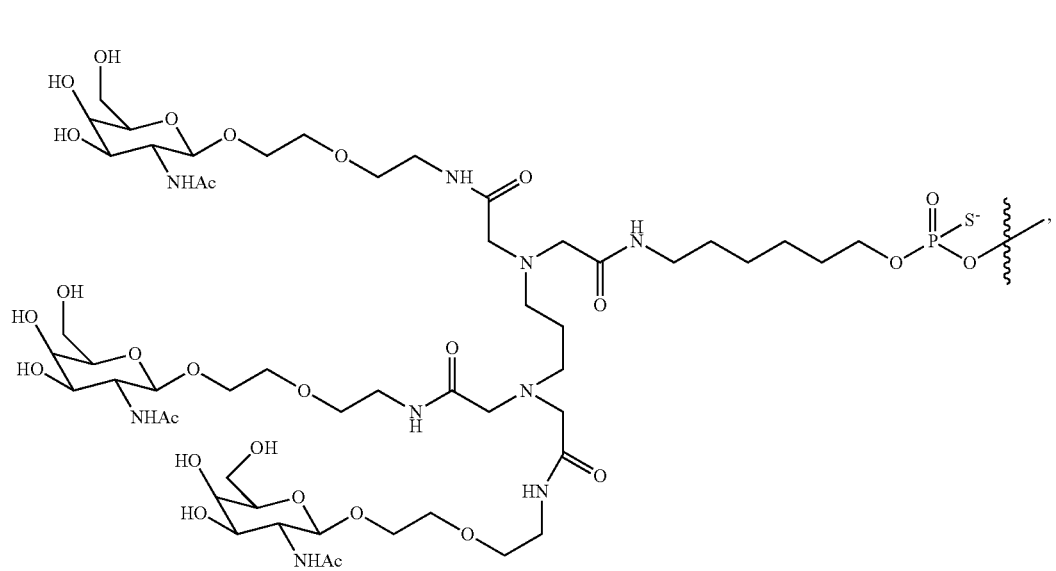

GLS-1

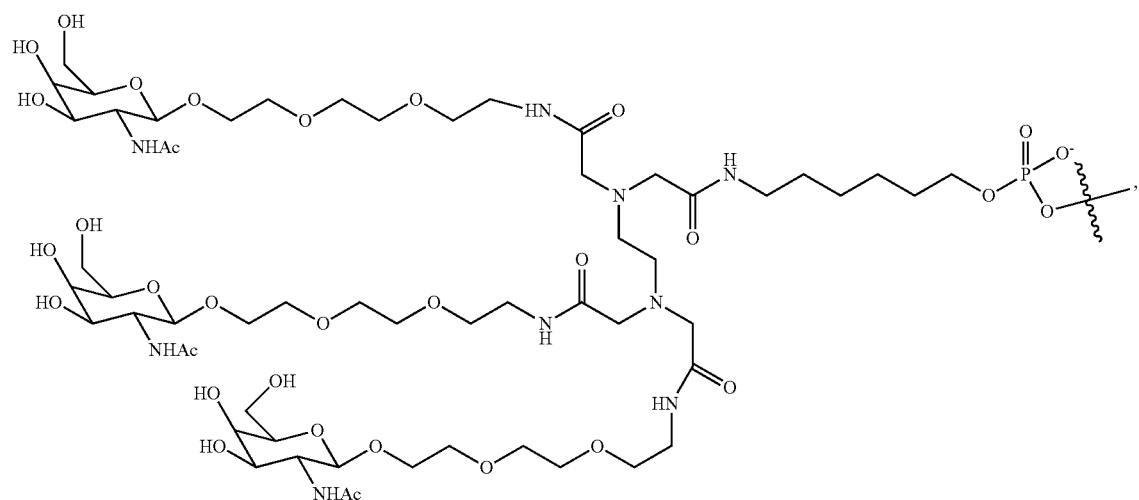
GLO-2
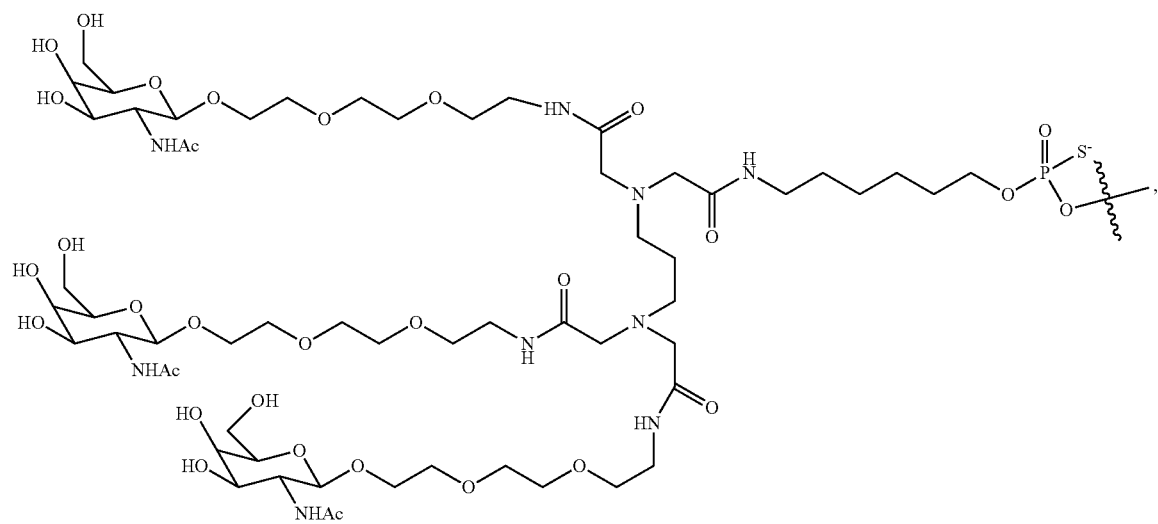
GLS-2
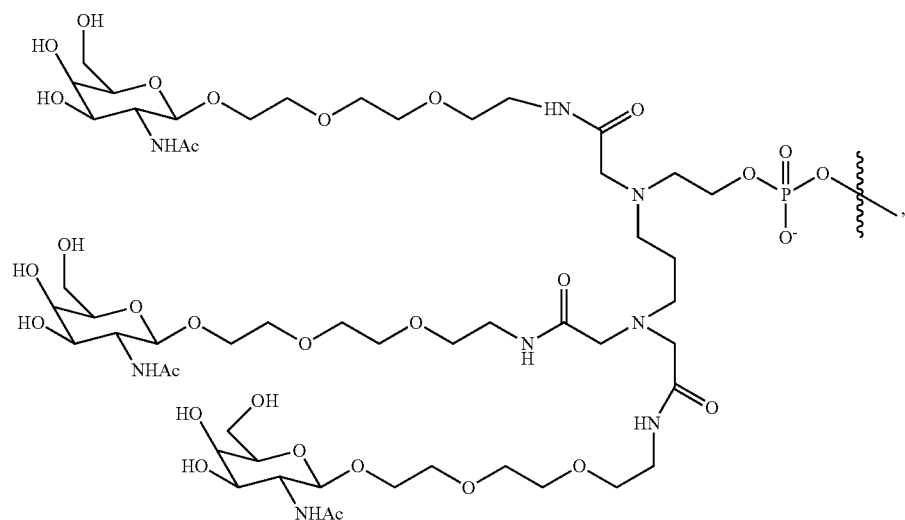
GLO-3

GLS-3
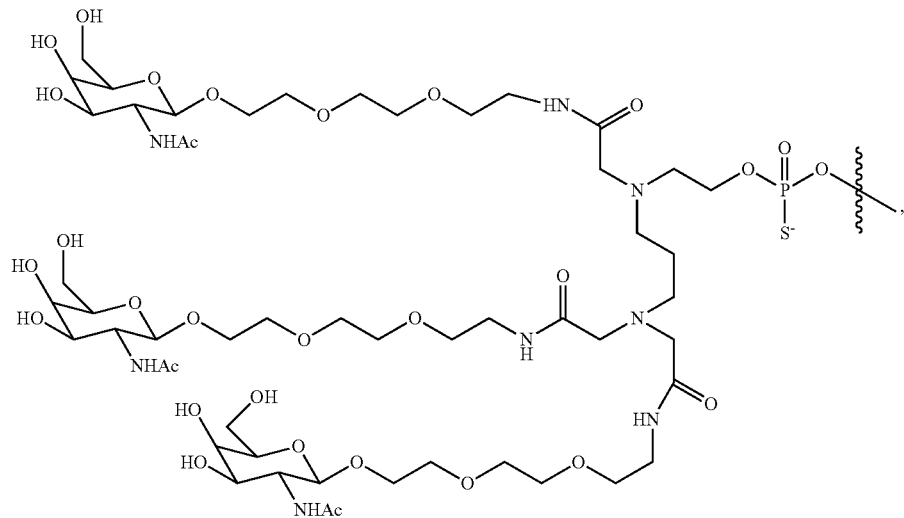
GLO-4
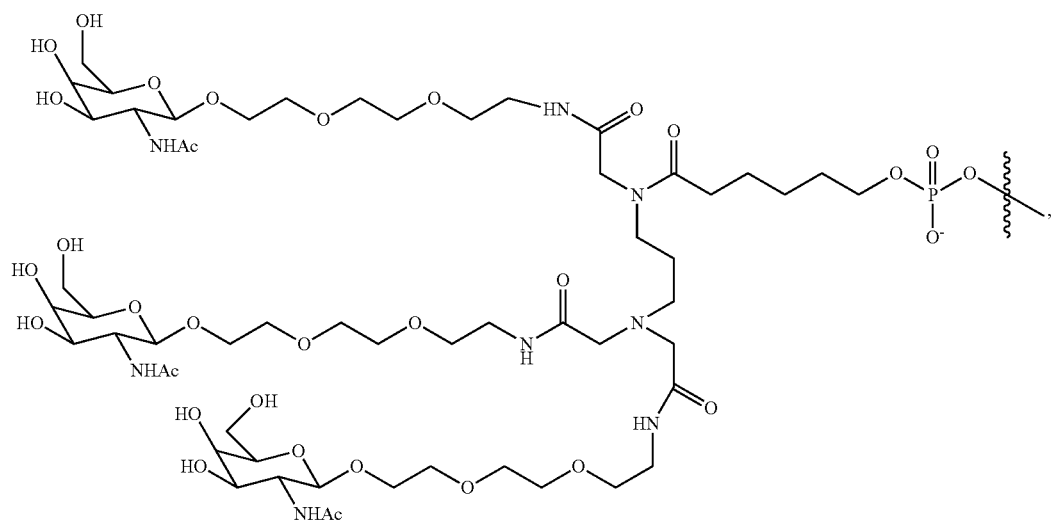
GLS-4
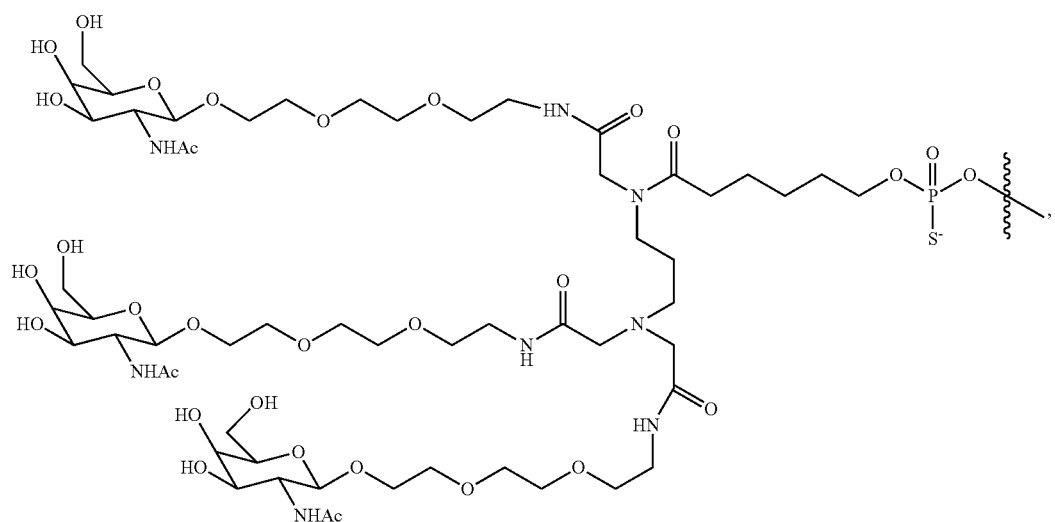

GLO-5
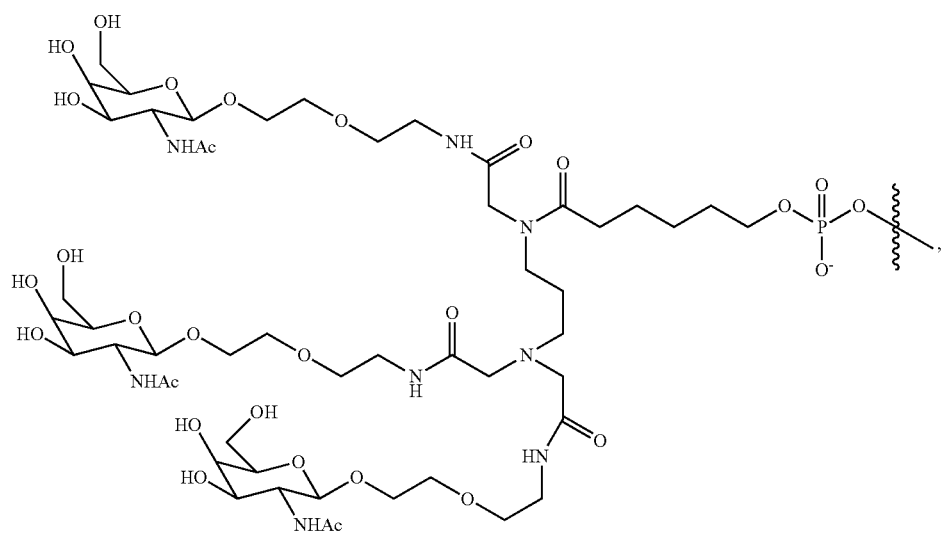
GLS-5
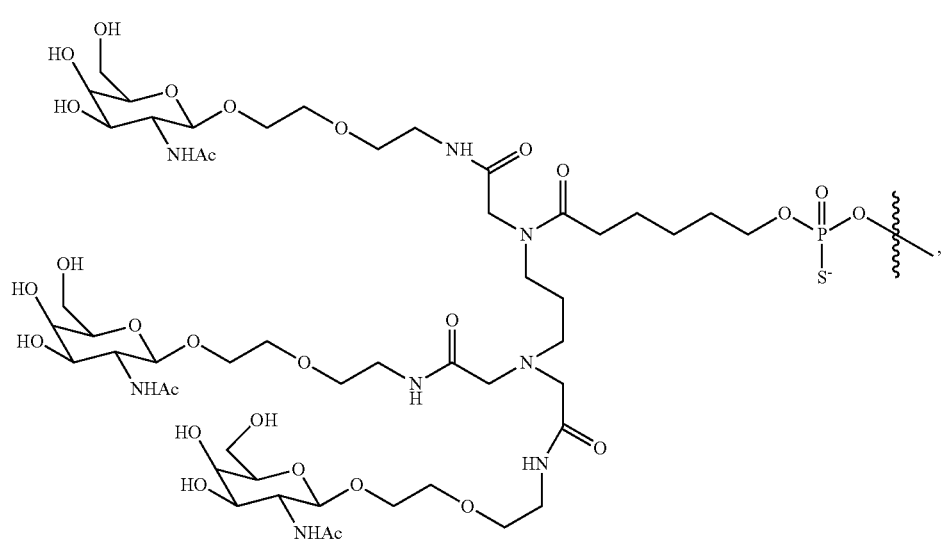
GLO-6
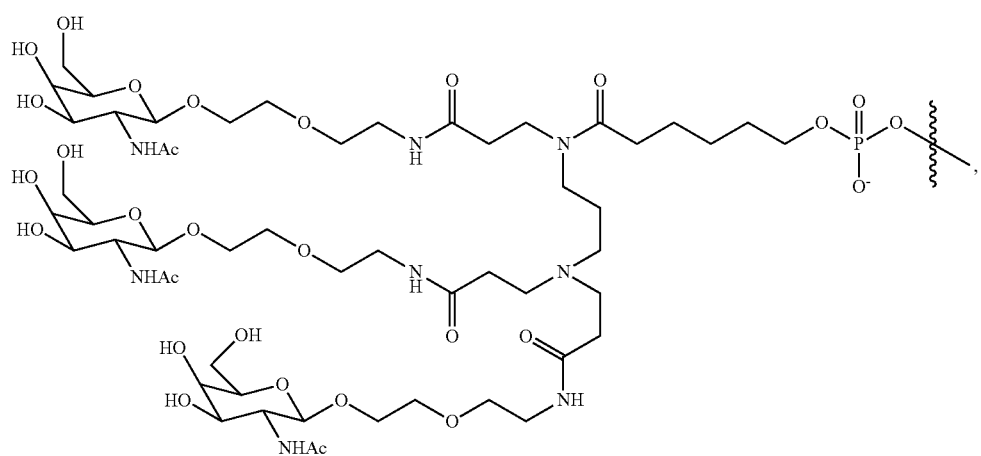

GLS-6
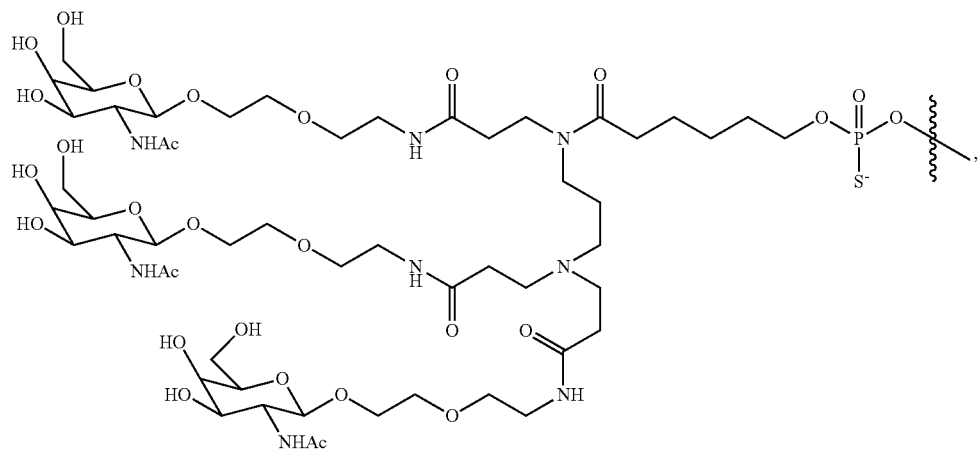
GLO-7
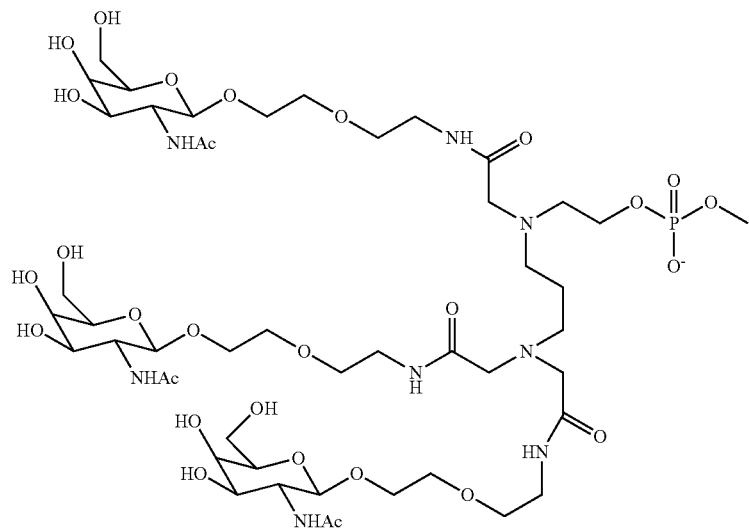
GLS-7
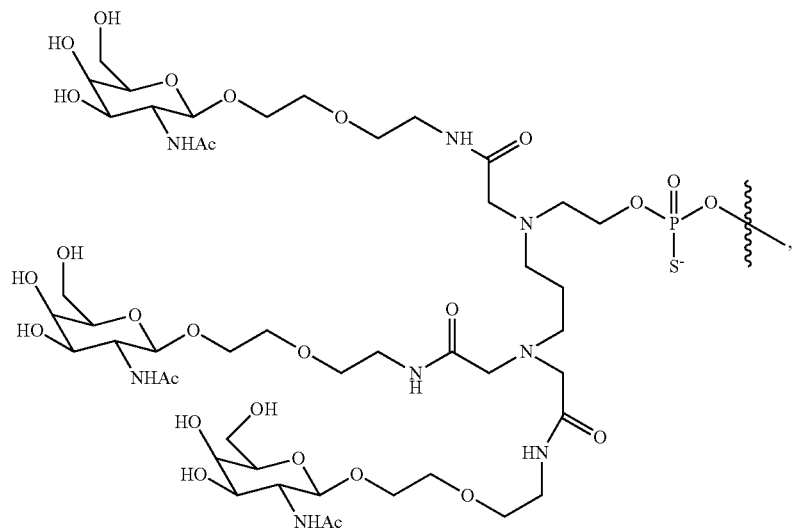

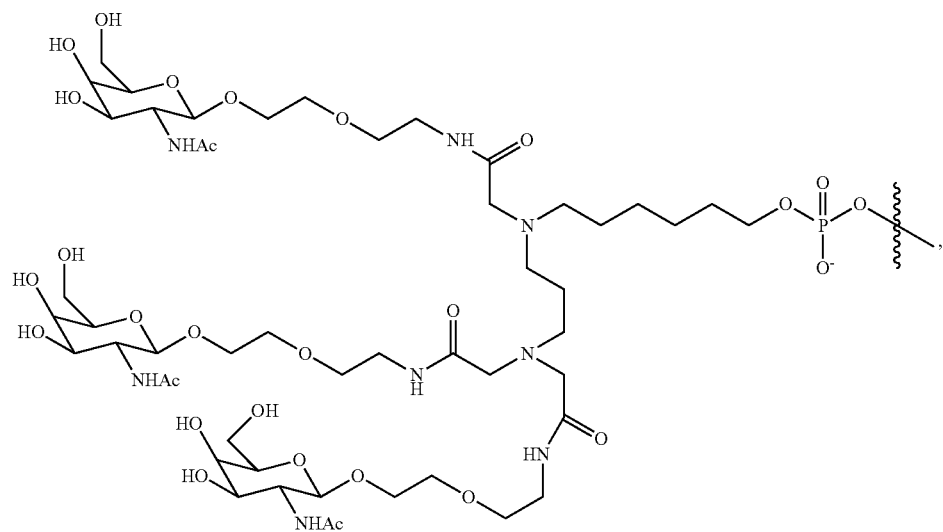
GLO-8
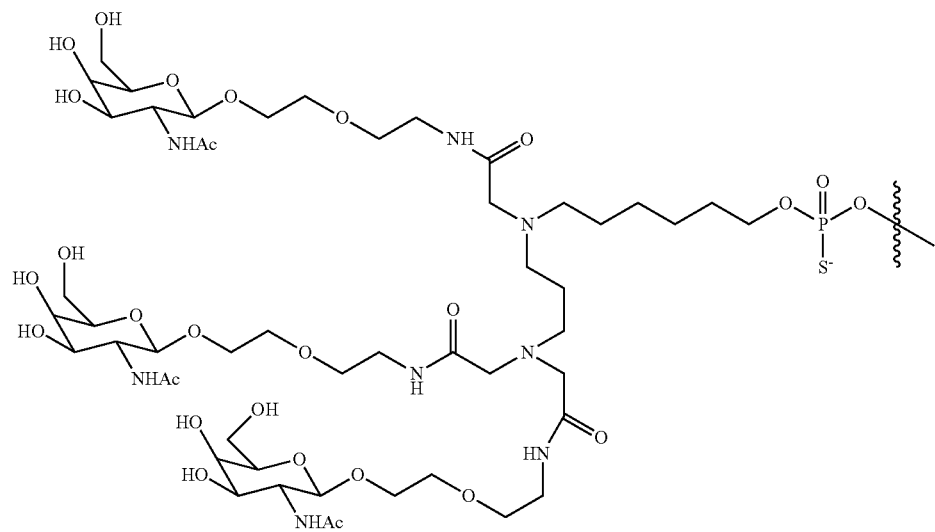
GLS-8

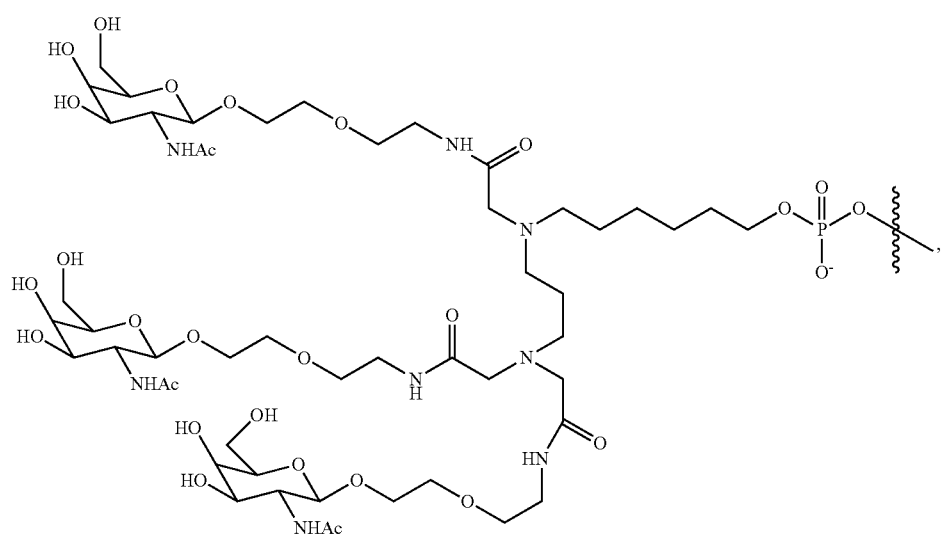
GLO-9
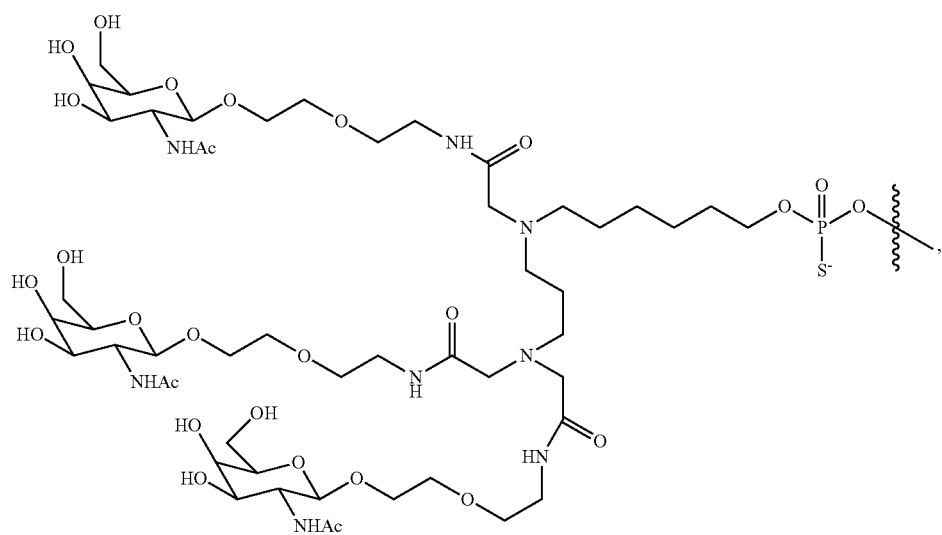
GLS-9
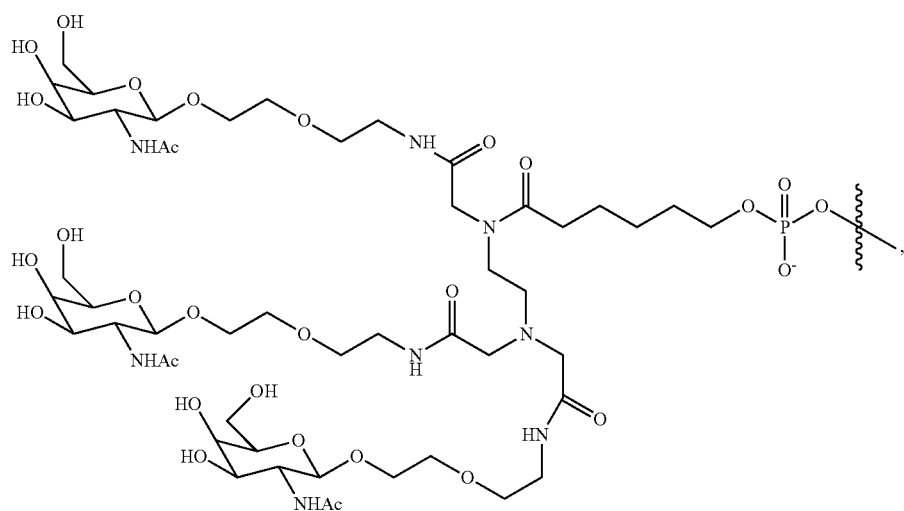
GLO-10

-continued
GLS-10
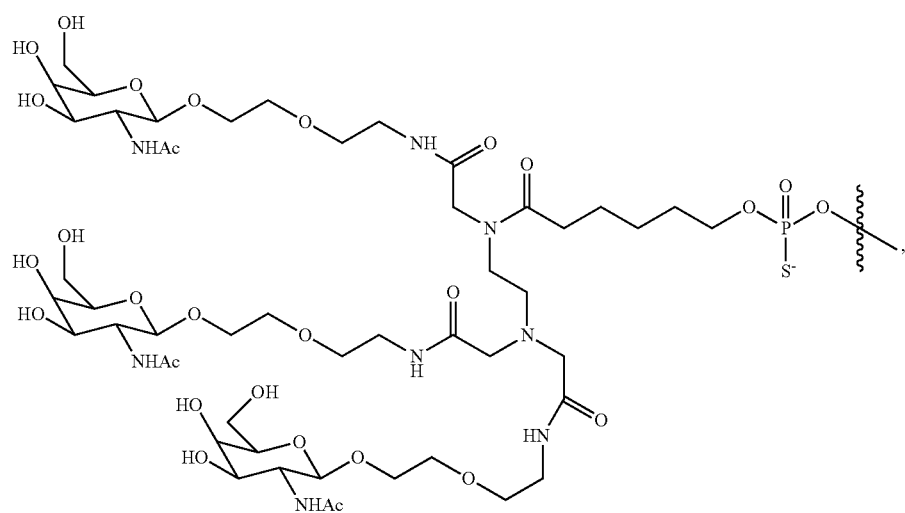
GLO-11
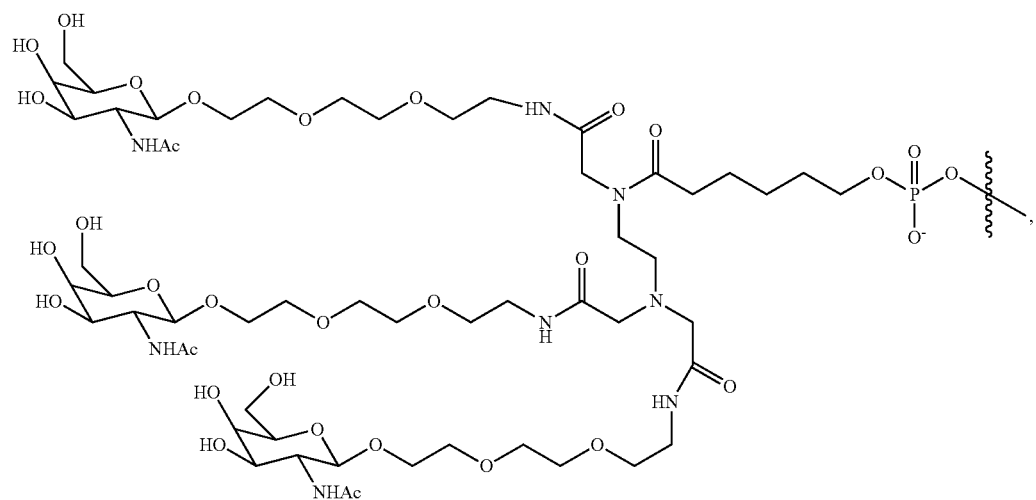
GLS-11
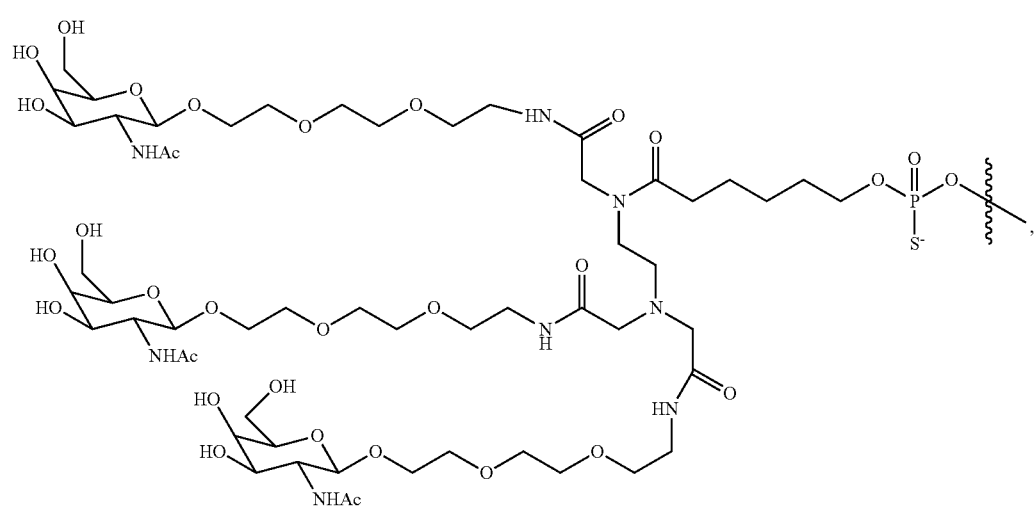

-continued
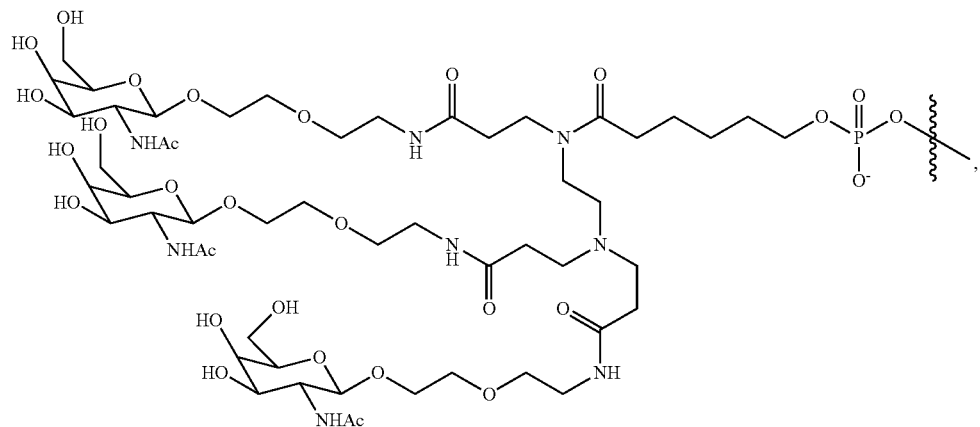
GLO-12
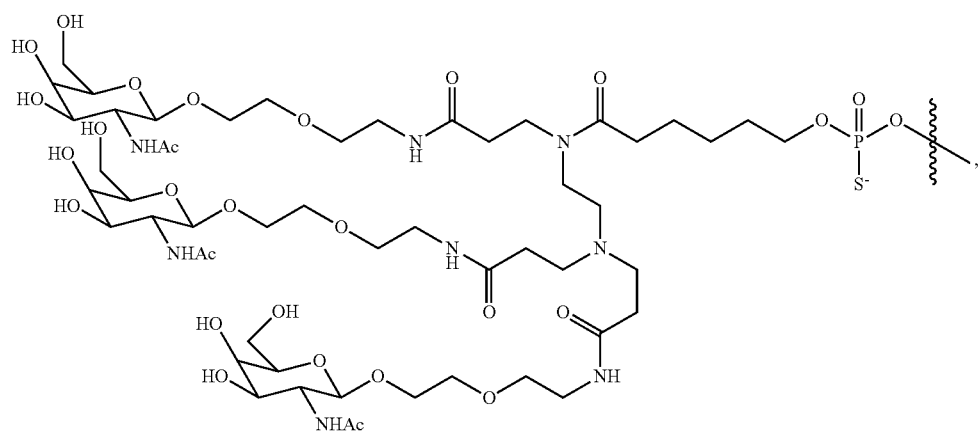
GLS-12
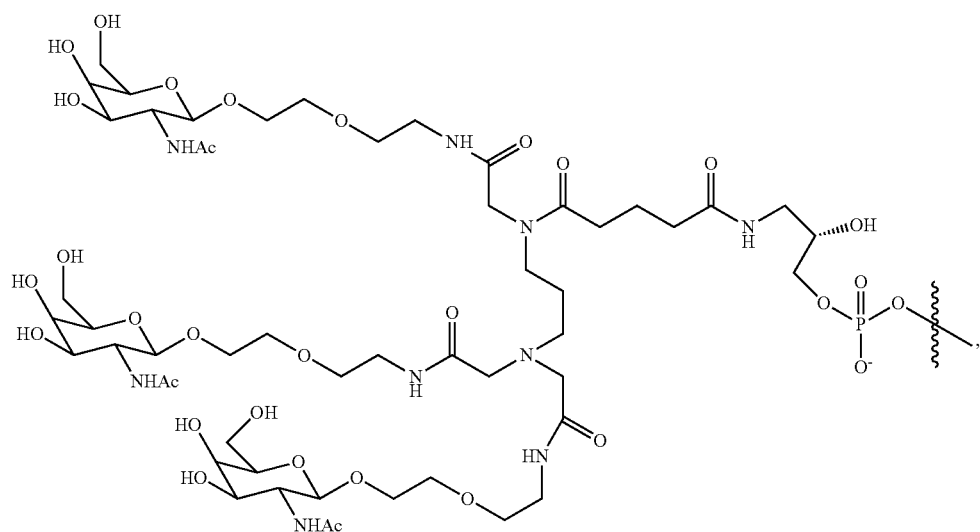
GLO-13

GLS-13
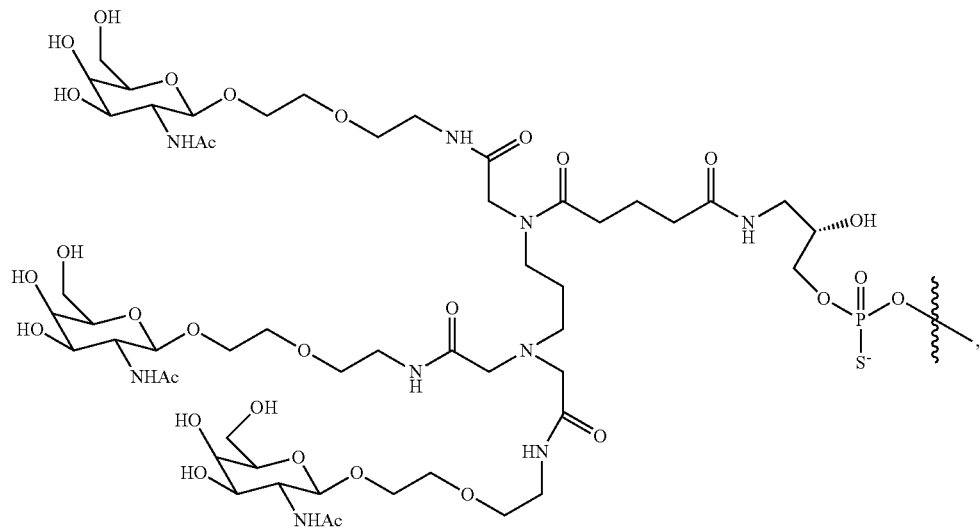
GLO-14
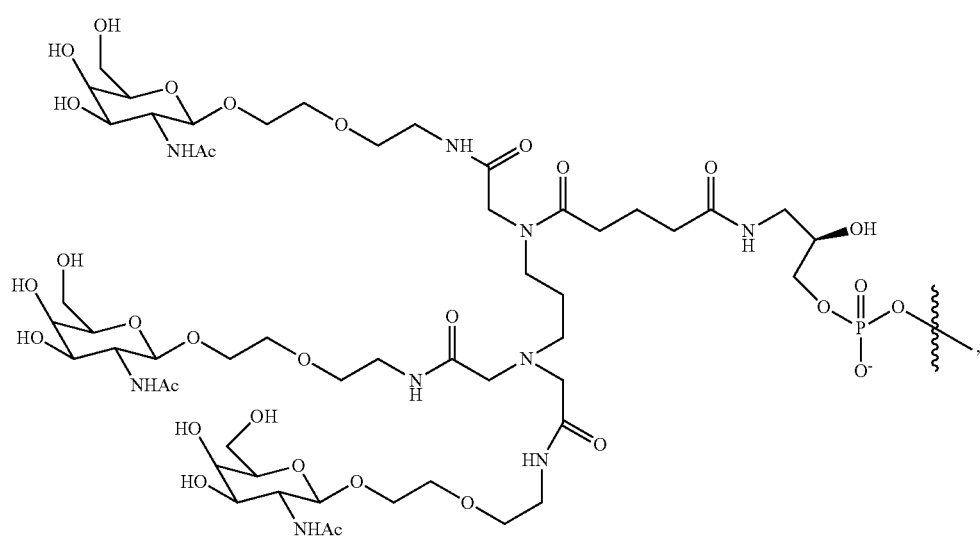
GLS-14
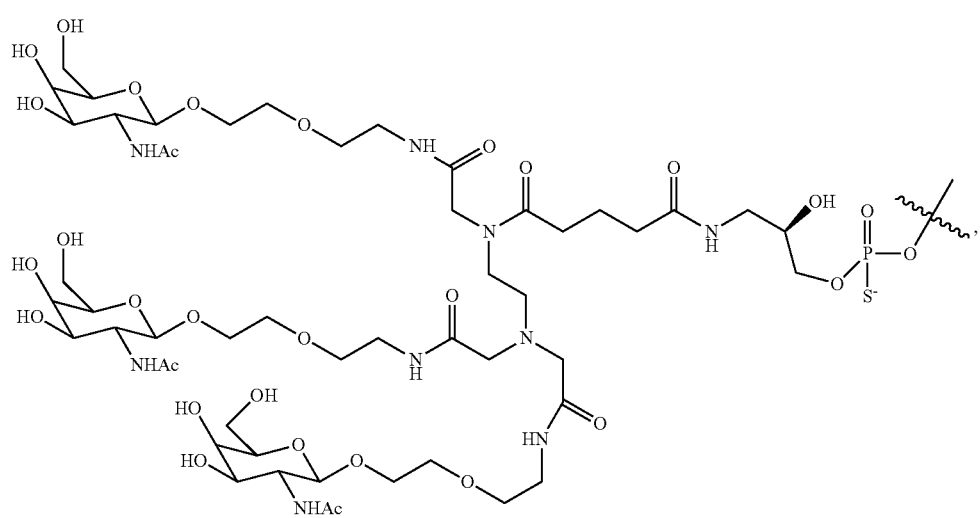

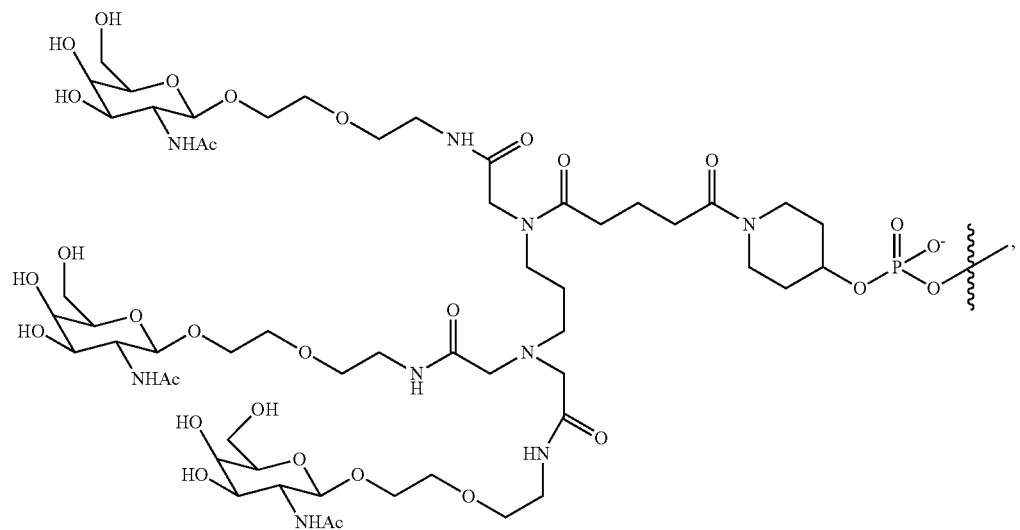
GLO-15
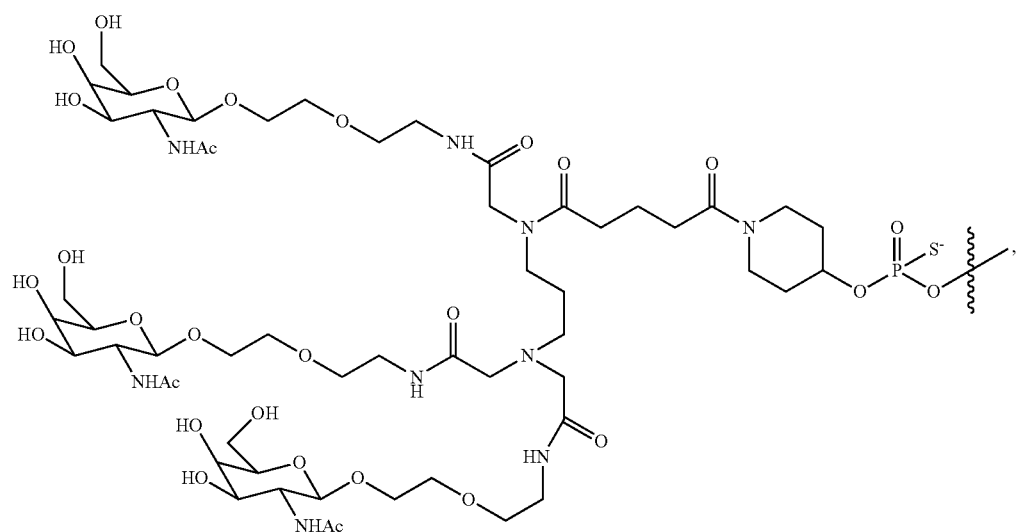
GLS-15
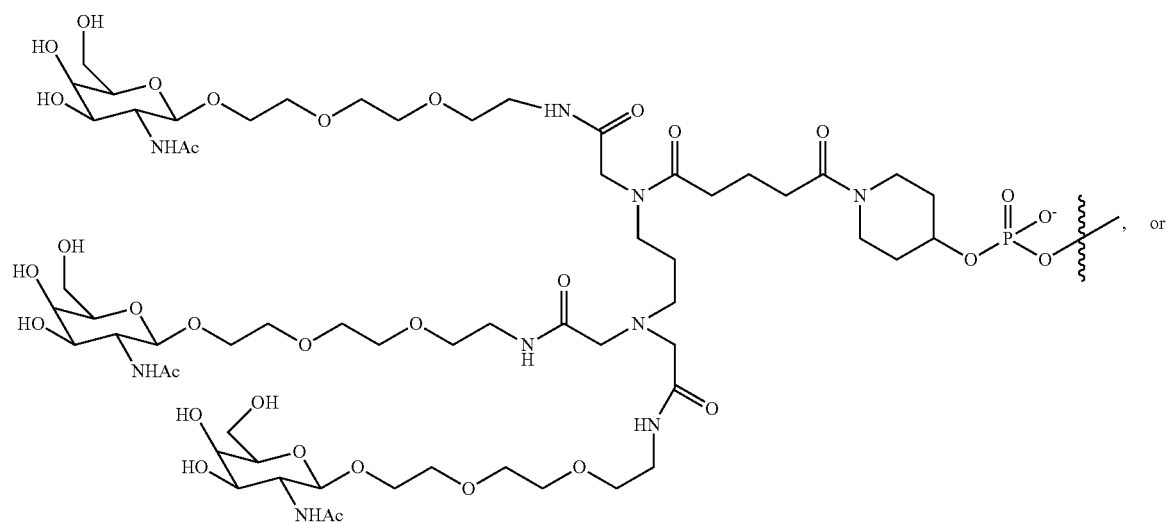
GLO-16, or

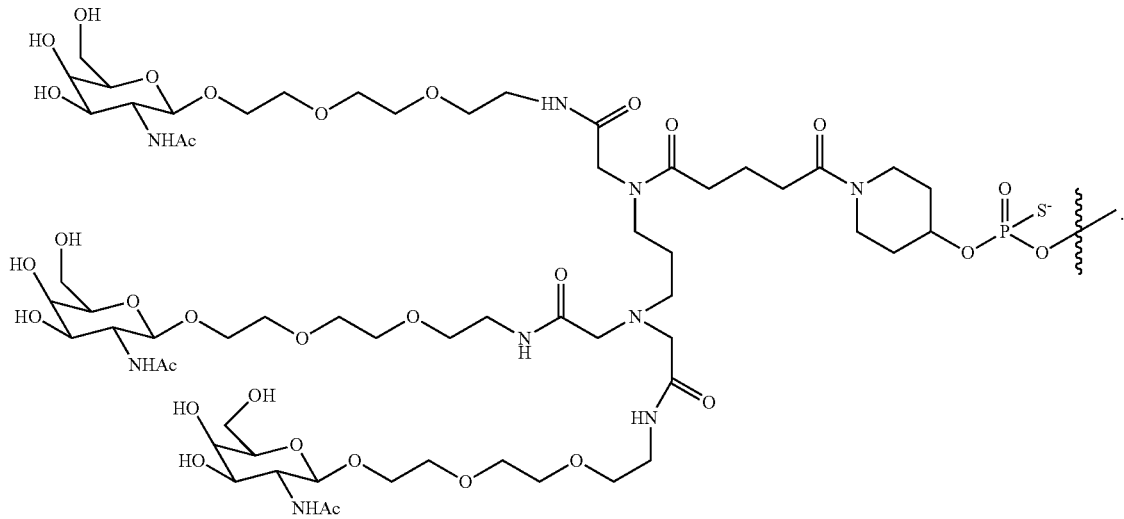

GLS-16

In certain embodiments, the dsRNA agent comprises a targeting group conjugated to the 5'-end of the sense strand. In some embodiments, the dsRNA agent comprises a targeting group conjugated to the 3'-end of the sense strand. In some embodiments, the antisense strand comprises an inverted abasic residue at the 3'-end. In certain embodiments, the sense strand comprises one or two inverted abasic residues at the 3' and/or 5' ends. In some embodiments, the dsRNA agent has two blunt ends. In some embodiments, at least one strand includes a 3' overhang that is at least 1 nucleotide long. In some embodiments, at least one strand includes a 3' overhang that is at least 2 nucleotides long.

In certain embodiments, the invention relates to unlocked nucleic acid (UNA) oligomers for use in therapy. Unlocked nucleic acid (UNA) is an acyclic analogue of RNA in which the bond between the C2' and C3' atoms of the ribose ring has been severed. Incorporation of UNA has been shown to be well tolerated and in some cases even enhance the activity of siRNA gene silencing (Meghan A. et al. "Locked vs. unlocked nucleic acids (LNA vs. UNA): contrasting structures work towards common therapeutic goals". *Chem. Soc. Rev.*, 2011, 40, 5680-5689).

UNA is a thermolabile modification, and replacing ribonucleotides with UNA will reduce base pairing strength and duplex stability. Strategic placement of UNA in the seed region of the siRNA antisense strand can reduce off-target activity in gene silencing mechanisms mediated by microRNA (miRNA). miRNA mainly recognizes target genes through base pairing between the antisense seed region (positions 2-8 from the 5' end) and the target mRNA for gene suppression. Each miRNA has the potential to regulate a large number of genes. The siRNA antisense strand loaded by the RNA-induced silencing complex (RISC) can also potentially regulate a large number of unintended genes through miRNA-mediated mechanisms. Therefore, adding thermolabile nucleotides, such as UNA, to the seed region of siRNA can reduce off-target activity (Lam J K, Chow M Y, Zhang Y, Leung S W. siRNA Versus miRNA as Therapeutics for Gene Silencing. *Mol Ther Nucleic Acids*. 2015 Sep. 15; 4 (9): e252. doi: 10.1038/mtna.2015.23. PMID: 26372022; PMCID: PMC4877448). In particular, such RNA oligonucleotides or complexes of RNA oligonucleotides contain at least one UNA nucleotide monomer in the seed region (Narendra Vaish et al. "Improved specificity of gene silencing by siRNAs containing unlocked nucleobase analog". *Nucleic Acids Research*, 2011, Vol. 39, No. 5 1823-1832).

Potential advantages of incorporating UNA in RNA oligonucleotides or complexes of RNA oligonucleotides in accordance with the present technical solution include, but are not limited to:

1. Reduced off-target activity. Adding UNA to the siRNA seed region will reduce the base pairing strength of the seed region, thereby reducing potential off-target activity caused by the micro-RNA mechanism.
2. Good toleration of UNA in terms of siRNA activity. In some cases, UNA can lead to increased activity.

Exemplary UNA monomers that can be used in this technical solution include, but are not limited to:

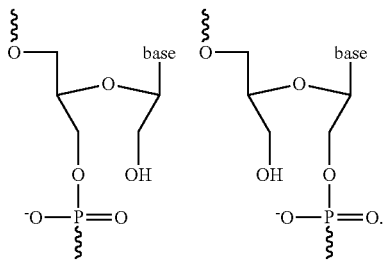

In some embodiments, the dsRNA agent is a modified duplex selected from any one of duplexes AD00158-19-2, AD00158-19-1, AD00158-3, AD00158-1, AD00158-2, AD00158, AD00159, AD00159-1, AD00159-2, AD00159-19-1, AD00159-19-2, AD00163, AD00163-1, AD00163-2, AD00163-19-1, AD00163-19-2, AD00163-3, AD00300-1, AD00300-19-1 and AD00300-19-2 in Tables 2-4.

In some embodiments, the dsRNA agent is a modified duplex selected from any of the duplexes AV01227, AV01228, AV01229, AV01230, AV01231, AV01232, AV01233, AV01234, AV01235, AV01236, AV01237, AV01238, AV01239, AV01240, AV01241, AV01242, AV01243, AV01244, AV01245, AV01246, AV01247, AV01248, AV01249, AV01250, AV01251, AV01252, AV01253, AV01254, AV01255, AV01256 and AV01257 in Tables 2-4.

According to one aspect of the invention, there is provided a composition comprising any embodiment of the aforedescribed dsRNA agent aspect of the invention. In certain embodiments, the composition further comprises a pharmaceutically acceptable carrier. In some embodiments, the composition further comprises one or more additional therapeutic agents. In certain embodiments, the composition is packaged in kits, containers, packs, dispensers, prefilled syringes, or vials. In some embodiments, the composition is formulated for subcutaneous or intravenous (IV) administration.

According to another aspect of the invention, there is provided a cell comprising any embodiment of the aforedescribed dsRNA agent aspect of the invention. In some embodiments, the cell is a mammalian cell, optionally a human cell.

According to another aspect of the present invention, there is provided a method for inhibiting the expression of AGT gene in a cell, said method comprising: (i) preparing a cell comprising an effective amount of any embodiment of the aforementioned dsRNA agent or the aforementioned composition of the invention. In certain embodiments, the method further comprises: (ii) maintaining the prepared cells for a sufficient time to obtain degradation of the mRNA transcript of the AGT gene, thereby inhibiting the expression of the AGT gene in the cell. In some embodiments, the cells are in a subject and the dsRNA agent is administered subcutaneously to the subject. In some embodiments, the cells are in a subject and the dsRNA agent is administered to the subject by IV administration. In certain embodiments, the method further comprises assessing inhibition of the AGT gene after administering the dsRNA agent to the subject, wherein the means of this assessment comprises: (i) determining one or more physiological characteristics of an AGT-associated disease or condition in the subject, and (ii) comparing the determined physiological characteristic to a baseline pre-treatment physiological characteristic of the AGT-associated disease or condition and/or a control physiological characteristic of the AGT-associated disease or condition, wherein the comparison indicates a presence or absence of inhibition of expression of the AGT gene in the subject. In some embodiments, the physiological characteristic determined is the level of AGT in the blood. In some embodiments, the physiological characteristic determined is blood pressure, which includes systolic blood pressure (SBP), diastolic blood pressure (DBP), and mean arterial pressure (MAPR). A decrease in the AGT level in the blood and/or blood pressure indicates reduction of AGT gene expression in the subject.

According to another aspect of the present invention, there is provided a method for inhibiting the expression of the AGT gene in a subject, which includes administering to the subject an effective amount of an embodiment of the foregoing dsRNA agent aspect or an embodiment of the foregoing composition. In some embodiments, the dsRNA agent is administered subcutaneously to the subject. In certain embodiments, the dsRNA agent is administered to the subject via IV administration. In some embodiments, the method further comprises: assessing inhibition of the AGT gene after administration of the dsRNA agent, wherein the means of assessment includes: (i) determining one or more physiological characteristics of an AGT-associated disease or condition in the subject; (ii) comparing the determined physiological characteristic to a baseline pre-treatment physiological characteristic of an AGT-associated disease or condition and/or a control physiological characteristic of an AGT-associated disease or condition, wherein the comparison is indicative of the presence or absence of inhibition of expression of the AGT gene in the subject. In some embodiments, the physiological characteristic determined is the level of AGT in the blood; in some embodiments, the physiological characteristic determined is blood pressure, which includes systolic blood pressure (SBP), diastolic blood pressure (DBP), and mean arterial pressure (MAPR). A decrease in AGT levels in the blood and/or blood pressure indicates a reduction of AGT gene expression in the subject.

According to another aspect of the present invention, there is provided a method of treating a disease or condition associated with the AGT protein, which comprises: administering to a subject an effective amount of any embodiment of the foregoing dsRNA agent aspect of the present invention or the foregoing composition of the invention, so as to inhibit AGT gene expression. In certain embodiments, the AGT-associated disorder is selected from: hypertension, high blood pressure, borderline hypertension, essential hypertension, secondary hypertension, isolated systolic or diastolic hypertension, pregnancy-related hypertension, diabetic hypertension, resistant hypertension, refractory hypertension, paroxysmal hypertension, renovascular hypertension, Goldblatt's hypertension, ocular hypertension, glaucoma, pulmonary hypertension, portal hypertension, systemic venous hypertension, systolic hypertension, unstable hypertension; hypertensive heart disease, hypertensive nephropathy, atherosclerosis, arteriosclerosis, vasculopathy, diabetic nephropathy degeneration, diabetic retinopathy, chronic heart failure, cardiomyopathy, diabetic cardiomyopathy, glomerulosclerosis, aortic stenosis, aortic aneurysm, ventricular fibrosis, heart failure, myocardial infarction, angina, stroke, renal disease, renal failure, systemic sclerosis, intrauterine growth retardation (IUGR), and fetal growth restriction. In some embodiments, the method further comprises administering an additional treatment regimen to the subject. In some embodiments, the additional treatment regimen includes treatment of an AGT-associated disease or condition. In certain embodiments, the additional treatment regimen comprises: administering to the subject one or more AGT antisense polynucleotides of the invention; administering to the subject a non-AGT dsRNA therapeutic agent; and effecting behavioral changes in the subject. In some embodiments, the non-AGT dsRNA therapeutic agent is one of the following: additional therapeutic agents such as diuretics, angiotensin converting enzyme (ACE) inhibitors, angiotensin II receptor antagonists, beta-blockers, vasodilators, calcium channel blockers, aldosterone antagonists, α2-agonists, renin inhibitors, α-blockers, peripherally acting adrenergic agents, selective D1 receptor partial agonists, non-selective alpha-adrenergic antagonists, synthetic steroidal antimineralocorticoids, or combinations of any of the foregoing, and therapeutic agents for hypertension formulated as pharmaceutical combinations.

In some embodiments, the dsRNA agent is administered subcutaneously to the subject. In certain embodiments, the dsRNA agent is administered to the subject via IV administration. In some embodiments, the method further comprises determining the efficacy of the administered double-stranded ribonucleic acid (dsRNA) agent in the subject. In some embodiments, the means for determining the efficacy of a treatment in a subject comprises: (i) determining one or more physiological characteristics of an AGT-associated disease or condition in the subject; (ii) correlating the determined physiological characteristics with the AGT-associated disease or a condition, wherein the comparison indicates one or more of a presence, absence, and level of efficacy of a double-stranded ribonucleic acid (dsRNA) agent administered to the subject. In some embodiments, the physiological characteristic determined is the level of AGT in the blood; in some embodiments, the physiological characteristic determined is blood pressure, which includes systolic blood pressure (SBP), diastolic blood pressure (DBP), and mean arterial pressure (MAPR). A decrease in AGT levels in the blood and/or blood pressure indicates the presence of effectiveness of the double-stranded ribonucleic acid (dsRNA) agent administered to the subject.

According to another aspect of the invention, there is provided a method of reducing the level of AGT protein in a subject as compared to a baseline pre-treatment level of AGT protein in the subject, comprising administering to the subject an effective amount of any embodiment of the foregoing dsRNA agent aspect of the invention or any embodiment of the foregoing composition of the invention, so as to reduce the level of AGT gene expression. In some embodiments, the dsRNA agent is administered to the subject subcutaneously or by IV.

According to another aspect of the invention, there is provided a method of altering a physiological characteristic of an AGT-associated disease or condition in a subject as compared to a baseline pre-treatment physiological characteristic of the AGT-associated disease or condition in the subject, said method comprising administering to the subject an effective amount of any embodiment of the foregoing dsRNA agent aspect of the invention or any embodiment of the foregoing composition of the invention, so as to alter the physiological characteristic of the AGT-associated disease or condition in the subject. In some embodiments, the dsRNA agent is administered to the subject subcutaneously or by IV. In certain embodiments, the physiological characteristic is the level of AGT in the blood; in some embodiments, the physiological characteristic determined is blood pressure, which includes systolic blood pressure (SBP), diastolic blood pressure (DBP), and mean arterial pressure (MAPR).

Description of the Sequences

Duplexes AD00051 to AD00122-19-2, AD00163-3, AV01227 to AVAV01257 and AV01711 are shown in Table 1, and their sense strand sequences are shown.

Duplexes AD00051 to AD00122-19-2, AD00163-3, AV01227 to AVAV01257 and AV01711 are shown in Table 1, and their antisense strand sequences are shown.

```
SEQ ID NO: 519 is human angiotensinogen (AGT) mRNA
[NCBI Reference Sequence: NM_001384479.1]:
GAAGAAGCTGCCGTTGTTCTGGGTACTACAGCAGAAGGGTATGCGGAAGCGAGCACC

CCAGTCTGAGATGGCTCCTGCCGGTGTGAGCCTGAGGGCCACCATCCTCTGCCTCCTG

GCCTGGGCTGGCCTGGCTGCAGGTGACCGGGTGTACATACACCCCTTCCACCTCGTC

ATCCACAATGAGAGTACCTGTGAGCAGCTGGCAAAGGCCAATGCCGGGAAGCCCAA

AGACCCCACCTTCATACCTGCTCCAATTCAGGCCAAGACATCCCCTGTGGATGAAAAG

GCCCTACAGGACCAGCTGGTGCTAGTCGCTGCAAAACTTGACACCGAAGACAAGTTG

AGGGCCGCAATGGTCGGGATGCTGGCCAACTTCTTGGGCTTCCGTATATATGGCATGC

ACAGTGAGCTATGGGGCGTGGTCCATGGGCCACCGTCCTCTCCCCAACGGCTGTCTT

TGGCACCCTGGCCTCTCTCTATCTGGGAGCCTTGGACCACACAGCTGACAGGCTACA

GGCAATCCTGGGTGTTCCTTGGAAGGACAAGAACTGCACCTCCCGGCTGGATGCGCA

CAAGGTCCTGTCTGCCCTGCAGGCTGTACAGGGCCTGCTAGTGGCCCAGGGCAGGGC

TGATAGCCAGGCCCAGCTGCTGCTGTCCACGGTGGTGGGCGTGTTCACAGCCCCAGG

CCTGCACCTGAAGCAGCCGTTTGTGCAGGGCCTGGCTCTCTATACCCCTGTGGTCCTC

CCACGCTCTCTGGACTTCACAGAACTGGATGTTGCTGCTGAGAAGATTGACAGGTTC

ATGCAGGCTGTGACAGGATGGAAGACTGGCTGCTCCCTGATGGGAGCCAGTGTGGAC

AGCACCCTGGCTTTCAACACCTACGTCCACTTCCAAGGGAAGATGAAGGGCTTCTCC

CTGCTGGCCGAGCCCCAGGAGTTCTGGGTGGACAACAGCACCTCAGTGTCTGTTCCC

ATGCTCTCTGGCATGGGCACCTTCCAGCACTGGAGTGACATCCAGGACAACTTCTCG

GTGACTCAAGTGCCCTTCACTGAGAGCGCCTGCCTGCTGCTGATCCAGCCTCACTATG

CCTCTGACCTGGACAAGGTGGAGGGTCTCACTTTCCAGCAAAACTCCCTCAACTGGA

TGAAGAAACTATCTCCCCGGACCATCCACCTGACCATGCCCCAACTGGTGCTGCAAG

GATCTTATGACCTGCAGGACCTGCTCGCCCAGGCTGAGCTGCCCGCCATTCTGCACAC

CGAGCTGAACCTGCAAAAATTGAGCAATGACCGCATCAGGGTGGGGAGGTGCTGA

ACAGCATTTTTTTTGAGCTTGAAGCGGATGAGAGAGAGCCCACAGAGTCTACCCAAC
```

```
-continued
AGCTTAACAAGCCTGAGGTCTTGGAGGTGACCCTGAACCGCCCATTCCTGTTTGCTGT

GTATGATCAAAGCGCCACTGCCCTGCACTTCCTGGGCCGCGTGGCCAACCCGCTGAG

CACAGCATGAGGCCAGGGCCCCAGAACACAGTGCCTGGCAAGGCCTCTGCCCCTGG

CCTTTGAGGCAAAGGCCAGCAGCAGATAACAACCCCGGACAAATCAGCGATGTGTCA

CCCCCAGTCTCCCACCTTTTCTTCTAATGAGTCGACTTTGAGCTGGAAAGCAGCCGTT

TCTCCTTGGTCTAAGTGTGCTGCATGGAGTGAGCAGTAGAAGCCTGCAGCGGCACAA

ATGCACCTCCCAGTTTGCTGGGTTTATTTTAGAGAATGGGGGTGGGGAGGCAAGAAC

CAGTGTTTAGCGCGGGACTACTGTTCCAAAAAGAATTCCAACCGACCAGCTTGTTTGT

GAAACAAAAAAGTGTTCCCTTTTCAAGTTGAGAACAAAAATTGGGTTTTAAAATTAA

AGTATACATTTTTGCATTGCCTTCGGTTTGTATTTAGTGTCTTGAATGTAAGAACATGAC

CTCCGTGTAGTGTCTGTAATACCTTAGTTTTTTCCACAGATGCTTGTGATTTTTGAACA

ATACGTGAAAGATGCAAGCACCTGAATTTCTGTTTGAATGCGGAACCATAGCTGGTTA

TTTCTCCCTTGTGTTAGTAATAAACGTCTTGCCACAATAAGCCTCCAAAAA.

SEQ ID NO: 520 is mouse angiotensinogen (AGT) mRNA
[NCBI reference sequence: NM_007428.4]
ATGACTCCCACGGGGGCAGGCCTGAAGGCCACCATCTTCTGCATCTTGACCTGGGTC

AGCCTGACGGCTGGGGACCGCGTATACATCCACCCCTTCCATCTCCTTTACCACAACA

AGAGCACCTGCGCCCAGCTGGAGAACCCCAGTGTGGAGACACTCCCAGAGTCAACG

TTCGAGCCTGTGCCCATTCAGGCCAAGACCTCCCCTGTGAATGAGAAGACCCTGCAT

GATCAGCTCGTGCTGGCCGCCGAGAAGCTAGAGGATGAGGACCGGAAGCGGGCTGC

CCAGGTCGCAATGATCGCCAACTTCGTGGGCTTCCGCATGTACAAGATGCTGAATGAG

GCAGGAAGTGGGGCCAGTGGGGCCATCCTCTCACCACCAGCTCTCTTTGGCACCCTG

GTCTCTTTCTACCTTGGATCCTTAGATCCCACGGCCAGCCAGCTGCAGACGCTGCTGG

ATGTCCCTGTGAAGGAGGGAGACTGCACCTCCCGACTAGATGGACACAAGGTCCTCG

CTGCCCTGCGGGCCATTCAGGGCTTGCTGGTCACCCAGGGTGGGAGCAGCAGCCAGA

CACCCCTGCTACAGTCCATTGTGGTGGGGCTCTTCACTGCTCCAGGCTTTCGTCTAAA

GCACTCATTTGTTCAGAGCCTGGCTCTCTTTACCCCTGCCCTCTTCCCACGCTCTCTGG

ATTTATCCACTGACCCAGTTCTTGCCACTGAGAAAATCAACAGGTTCATAAAGGCTGT

GACAGGGTGGAAGATGAACTTGCCACTGGAGGGGGTCAGTACAGACAGCACCCTAC

TTTTCAACACCTACGTTCACTTCCAAGGAACGATGAGAGGTTTCTCTCAGCTGCCTGG

AGTCCATGAATTCTGGGTGGACAACAGCATCTCGGTGTCTGTGCCCATGATCTCCGGC

ACTGGCAACTTCCAGCACTGGAGTGACACCCAGAACAACTTCTCCGTGACGTGCGTG

CCCCTAGGTGAGAGAGCCACCCTGCTGCTCATCCAGCCCCACTGCACCTCAGATCTCG

ACAGGGTGGAGGCCCTCATCTTCCGGAACGACCTCCTGACTTGGATAGAGAACCCGC

CTCCTCGGGCCATCCGCCTGACTCTGCCCCAGCTGGAAATCCGAGGATCCTACAATCT

GCAGGACCTGCTGGCTGAGGACAAGCTGCCCACCCTTTTGGGTGCGGAGGCAAATCT

GAACAACATTGGTGACACCAACCCCCGAGTGGGAGAGGTTCTCAATAGCATCCTCCT

CGAACTCAAAGCAGGAGAGGAGGAACAGCCGACCACGTCTGTCCAGCAGCCTGGCT

CACCGGAGGCACTGGATGTGACCCTGAGCAGCCCCTTCCTGTTCGCCATCTACGAGC

AGGACTCAGGCACGCTGCACTTTCTGGGCAGAGTGAATAACCCCCAGAGTGTGGTGT

GA
```

-continued

SEQ ID NO: 521 is cynomolgus monkey angiotensinogen (AGT)
mRNA [NCBI reference sequence: NM_001283634.1]
ATGCAGAAGCGAGCACCCCAGTCCGAGATGGCTCCTGCCAGCGTGAGCCTGAGGGC

CACCATCCTCTGCCTCCTGGCCTGGGCTGGCCTGGCCACAGGTGACCGGGTGTACATA

CACCCCTTCCACCTCGTCATCCACAATGAGAGTACCTGTGAGCAGCTGGCAAAGGCC

GATGCTGGGAAGCCCAAAGATCCCACCTTCACACCTGTTCCGATACAGGCCAAGACG

TCTCCTGTGGATGAAAAGGCCCTGCAGGACCAGCTAGTGCTGGTTGCCGCAAAACTC

GACACCGAGGACAAGTTGAGAGCCGCGATGGTCGGGATGCTGGCCAACTTCTTGGGC

TTCCGTATATATGGCATGCACAGTGAGCTATGGGGCGTGGTCCATGGGGCCACCATCCT

CTCCCCAACGGCTGTCTTTGGCACCCTGGCCTCTCTCTACCTGGGAGCGTTGGACCAC

ACAGCCGACAGGCTACAGGCAATCCTGGGCGTCCCTTGGAAGGACAAGAACTGCAC

CTCCCGGCTGGATGCGCACAAGGTCCTCTCTGCCCTGCAGGCTGTACAGGGCCTGCT

GGTGGCCCAGGGCAGGGCTGACGGCCAGTCCCAGCTGCTGTTGTCCACAGTGGTGG

GTCTCTTCACAGCCCCAGATCTGCACCTGAAGCAGCCGTTTGTGCAGGGCCTGGCTC

TCTATGCCCCTGTGGTCCTCCCACGCTCTCTGGACTTCACAGACCTGGAAGTCGCTGC

TGAGAAGATTGACAGGTTCATGCAGGCTGTGACAGGATGGAAGATTAGCAGCCCCCT

GACGGGAGCCAGTGCGGACAGCACCCTGGTTTTCAACACCTACGTCCATTTCCAAGG

GAAGATGAGGGACTTCTTCCTGCTGGCTGAGCCCCAGGAGTTCTGGGTGGACAACAG

CACCTCAGTGTCTGTCCCCATGCTGTCTGGCGTGGGCACCTTCCAGCACTGGAGCGA

CGCCCAGGACAACTTCTCAGTGACTCAAGTGCCCTTTACTGAGAGCGCCTGCTTGCT

GCTGATTCAGCCTCACTACGCCTCTGACCTGGACAAGGTGGAGGGTCTCACTTTCCA

GCAAAACTCCCTCAACTGGATGAAGAAACTGTCTCCCCGGGCCATCCACCTGACCAT

GCCCCGACTGGTGCTGCGAGGATCTTATGACCTGCAGGACCTGCTTGCCCAGGCTGA

GCTGCCCGCCATTCTGGGCACCGAGCTGAACCTGCAAAAATTGAGCAATGACAACCT

CAGGGTGGGGAAGGTGCTGAACAGCATTCTTTTTGAACTCGAAGCGGATGAGAGAG

AGCCCACAGAGTCTACCCGACAGCTGAACAGGCCTGAGTTCTTGGAGGTGACCCTGG

ACCGCCCATTCCTGTTTGCTGTGTATGATCAAAGTGCCACTGCCCTGCACTTCCTGGG

CCGTGTGGCCAACCCGCTGAGCCCAGCATGA

In the sequences shown in Table 2, chemical modifications are indicated as: upper case: 2'-fluoro; lower case: 2'-OMe; thiophosphate: *.

In the sequences shown in Table 3, the delivery molecules used in the in vivo studies are indicated by "GLO-0" at the 3' end of each sense strand. Chemical modifications are expressed as: upper case: 2'-fluoro; lower case: 2'-OMe; thiophosphate: *; unlocked nucleic acid: UNA (Note: AD00052, AD00113-AD00260; no UNA; AD00282-AD00301: UNA version).

In the sequences shown in Table 4, chemical modifications are indicated as: upper case: 2'-fluoro; lower case: 2'-OMe; thiophosphate: *; Invab=inverted abasic.

DETAILED DESCRIPTION OF THE PREFERRED EMBODIMENTS

Figure 1:
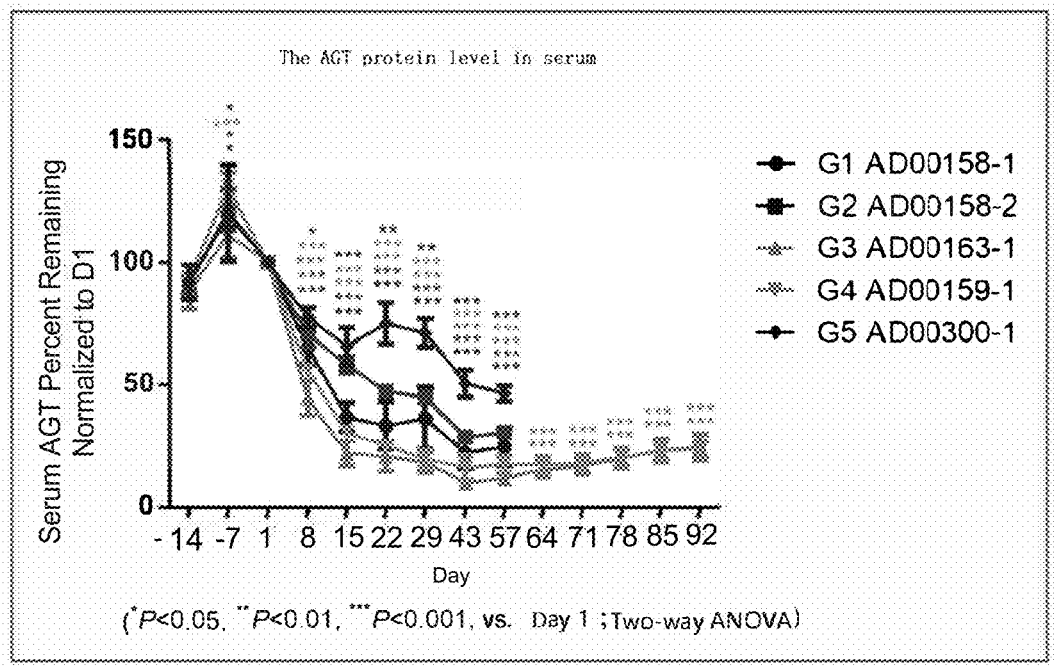
FIG. 1 is a graph showing the serum AGT protein levels in cynomolgus monkeys after administration of 2 mg/kg of AD00158-1, AD00158-2, AD00163-1, AD00159-1, and AD00300-1, respectively.

Some embodiments of the invention include RNAi agents capable of inhibiting expression of angiotensinogen (AGT) gene, such as, but not limited to, double-stranded (ds) RNAi agents. Some embodiments of the invention also include compositions comprising AGT RNAi agents and methods of using the compositions. AGT RNAi agents disclosed herein can be attached to delivery compounds for delivery to cells, including delivery to hepatocytes. Pharmaceutical compositions of the present invention may comprise at least one dsAGT agent and a delivery compound. In some embodiments of the invention, the delivery compound is a GalNAc-containing delivery compound. AGT RNAi agents delivered to cells are capable of inhibiting AGT gene expression, thereby reducing the activity of the gene's AGT protein product in the cell. The dsRNAi agents of the invention can be used to treat AGT-associated diseases and conditions. Such dsRNAi agents include, for example, the duplexes AD00051 to AD00122-19-2 shown in Table 1. In some embodiments, preferred dsRNAi agents include, for example, duplexes AD00158, AD00163, AD00159, AD00290, AD00300, or AD00122. In other embodiments, preferred dsRNAi agents include, for example, AD00158-1, AD00158-2, AD00163-1, AD00163-3.AD00159-1 or AD00300-1. In some other embodiments, such dsRNAi agents include duplex variants, such as variants of duplexes AD00158, AD00163, AD00163-3, AD00159, AD00290, AD00300 or AD00122.

In some embodiments of the invention, reducing AGT expression in a cell or subject treats a disease or condition associated with AGT expression in a cell or subject, respectively. Non-limiting examples of diseases and conditions that can be treated by reducing AGT activity are hypertension, high blood pressure, borderline hypertension, essential hypertension, secondary hypertension, isolated systolic or diastolic hypertension, gestational hypertension, diabetic hypertension, resistant hypertension, refractory hypertension, paroxysmal hypertension, renovascular hypertension, Goldblatt hypertension, ocular hypertension, glaucoma, pulmonary hypertension, portal hypertension, systemic venous hypertension, systolic hypertension, unstable hypertension, hypertensive heart disease, hypertensive nephropathy, atherosclerosis, arteriosclerosis, vascular disease, diabetic nephropathy, diabetic retinopathy, chronic heart failure, cardiomyopathy, diabetic cardiomyopathy, glomerulosclerosis, aortic stenosis, aortic aneurysm, ventricular fibrosis, heart failure, myocardial infarction, angina pectoris, stroke, kidney disease, renal failure, systemic sclerosis, intrauterine growth retardation (IUGR), and fetal growth restriction.

Described below is how to prepare and use compositions comprising AGT single-stranded (ssRNA) and double-stranded (dsRNA) agents to inhibit AGT gene expression, as well as compositions and methods for treating diseases and conditions caused or regulated by AGT gene expression. The term "RNAi" is also known in the art and may be referred to as "siRNA".

As used herein, the term "RNAi" refers to an agent that comprises RNA and mediates targeted cleavage of an RNA transcript through an RNA-induced silencing complex (RISC) pathway. As is known in the art, an RNAi target region refers to a contiguous portion of the nucleotide sequence of an RNA molecule formed during gene transcription, including messenger RNA (mRNA), which is a product of RNA processing of a primary transcription product. The target portion of the sequence will be at least long enough to serve as a substrate for RNAi-directed cleavage at or near this portion. The target sequence may be 8-30 nucleotides long (inclusive), 10-30 nucleotides long (inclusive), 12-25 nucleotides long (inclusive), 15-23 nucleotides long (inclusive), 16-23 nucleotides long (inclusive), or 18-23 nucleotides long (inclusive), including all shorter lengths within each specified range. In some embodiments of the invention, the target sequence is 9, 10, 11, 12, 13, 14, 15, 16, 17, 18, 19, 20, 21, 22, 23, 24, 25 or 26 nucleotides long. In certain embodiments, the target sequence is between 9 and 26 nucleotides in length, inclusive, including all subranges and integers therebetween. For example, though not intended to be limiting, in certain embodiments of the invention, the target sequence is 8, 9, 10, 11, 12, 13, 14, 15, 16, 17, 18, 19, 20, 21, 22, 23, 24, 25, 26, 27, 28, 29 or 30 nucleotides long, and is fully or at least substantially complementary to at least a portion of an RNA transcript of an AGT gene. Some aspects of the invention include pharmaceutical compositions comprising one or more AGT dsRNA agents and a pharmaceutically acceptable carrier. In certain embodiments of the invention, AGT RNAi as described herein inhibits expression of AGT protein.

As used herein, a "dsRNA agent" refers to a composition comprising an RNA or RNA-like (e.g. chemically modified RNA) oligonucleotide molecule that is capable of degrading or inhibiting translation of a target mRNA transcript. While not wishing to be bound to a particular theory, the dsRNA agents of the present invention may act through an RNA interference mechanism (i.e., induce RNA interference by interacting with the RNA interference pathway machinery (RNA-induced silencing complex or RISC) of mammalian cells), or act through any alternative mechanism(s) or pathway(s). Methods for silencing genes in plant, invertebrate and vertebrate cells are well known in the art (see for example Sharp et al., *Genes Dev.* 2001, 15:485; Bernstein, et al., (2001) *Nature* 409:363; Nykanen, et al., (2001) *Cell* 107:309; and Elbashir, et al., (2001) *Genes Dev.* 15:188)), the disclosures of which are incorporated herein by reference in their entirety. Gene silencing means known in the art can be used in conjunction with the disclosure provided herein to accomplish inhibition of AGT expression.

The dsRNA agents disclosed herein consist of a sense strand and an antisense strand, and include, but are not limited to: short interfering RNA (siRNA), RNAi agents, microRNA (miRNA), short hairpin RNA (shRNA) and dicer substrates. The antisense strand of the dsRNA agents described herein is at least partially complementary to the targeted mRNA, and it is understood in the art that dsRNA duplex structures of various lengths can be used to inhibit target gene expression. For example, dsRNAs with duplex structures of 19, 20, 21, 22, and 23 base pairs are known to effectively induce RNA interference (Elbashir et al., EMBO 2001, 20:6877-6888). It is also known in the art that shorter or longer RNA duplex structures are also effective at inducing RNA interference. The AGT dsRNA in certain embodiments of the invention may comprise at least one strand of at least 21 nt in length, or the duplex may have a length based on one of the sequences listed in Tables 1-4 minus 1, 2 or 3 nt, or even shorter. A reduction of four nucleotides at one or both ends compared to the dsRNA listed in Tables 1-4, respectively, may also be effective. In some embodiments of the invention, the AGT dsRNA agents may have a partial sequence of at least 15, 16, 17, 18, 19, 20 or more contiguous nucleotides from one or more sequences of Tables 1-4, and not differ in their ability to inhibit AGT gene expression by more than 5%, 10%, 15%, 20%, 25%, or 30% from the level of inhibition produced by a dsRNA comprising the entire sequence (also referred to here as the "parental" sequence).

Certain embodiments of the compositions and methods of the present invention include single-stranded RNA in the composition and/or administer single-stranded RNA to a subject. For example, the antisense strands listed in any of Tables 1-4 can be used as or within a composition that, when administered to a subject, reduces AGT polypeptide activity and/or expression of the AGT gene in the subject. Tables 1-4 show the antisense and sense strand core stretch base sequences of some AGT dsRNA agents. Single-stranded antisense molecules that may be included in certain compositions of the invention and/or administered in certain methods of the invention are referred to herein as "single-stranded antisense agents" or "antisense polynucleotide agents". Single-stranded sense molecules that may be included in certain compositions and/or administered in certain methods of the invention are referred to herein as "single-stranded sense agents" or "sense polynucleotide agents." The term "base sequence" as used herein refers to a polynucleotide sequence without chemical modifications or delivery compounds. For example, the sense strand shown in Table 1 corresponds to the corresponding base sequence in Table 3; however, the corresponding sequences in Table 3 show the respective chemical modifications and delivery compounds. Sequences disclosed herein may be assigned identifiers. For example, a single-stranded sense sequence may be identified by "sense strand SS #"; a single-stranded antisense sequence may be identified by "antisense strand AS #"; and a duplex comprising a sense strand and an antisense strand may be identified by "duplex AD #".

Table 1 includes the sense and antisense strands and provides the identification numbers of the duplexes formed by the sense and antisense strands on the same row in Table 1. In certain embodiments of the invention, the antisense sequence contains nucleobase u or nucleobase a in its first position. In certain embodiments of the invention, the antisense sequence comprises nucleobase u in its first position. As used herein, the term "matching position" refers in a sense to a position in each strand that "pairs" with each other when the two strands act as a duplex. For example, in a 21-nucleobase sense strand and a 21-nucleobase antisense strand, the nucleobase at position 1 of the sense strand is in a "matching position" with the nucleobase at position 21 of the antisense strand. In another non-limiting example in a 23-nucleobase sense strand and a 23-nucleobase antisense strand, the nucleobase at position 2 of the sense strand is in a matching position with position 22 of the antisense strand. In another non-limiting example in an 18-nucleobase sense strand and an 18-nucleobase antisense strand, the nucleobase at position 1 of the sense strand is in a matching position with the nucleobase at position 18 of the antisense strand, and the nucleobase at position 4 in the sense strand is in a matching position with the nucleobase at position 15 in the antisense strand. One skilled in the art will understand how to identify matching positions between the sense and antisense strands of duplexes and paired strands.

The last column in Table 1 shows a duplex AD #/AV # of a duplex comprising the sense and antisense sequences in the same table row. For example, Table 1 discloses a duplex designated "Duplex AD #AD00051", which comprises corresponding sense and antisense strand sequences. Thus, each row in Table 1 identifies a duplex of the invention, each comprising the sense and antisense sequences shown in the same row, and the designated identifier for each duplex is shown at the end of the row in a column.

In some embodiments of the methods of the invention, an RNAi agent comprising the polynucleotide sequence set forth in Table 1 is administered to the subject. In some embodiments of the invention, the RNAi agent administered to the subject includes a duplex comprising at least one of the base sequences listed in Table 1 and comprising 0, 1, 2, 3, 4, 5, 6, 7, 8, 9, 10, 11, 12, 13, 14, 15, 16, 17, 18, 19, 20, 21, 22, 23 or 24 sequence modifications. In some embodiments of the methods of the present invention, linking the RNAi agent of the polynucleotide sequence shown in Table 1 to a delivery molecule is further comprised, a non-limiting example of which is a delivery compound comprising GalNAc.

TABLE 1

Antisense and sense strand sequences of unmodified AGT RNAi agents. All sequences are shown in the 5' to 3' direction. Duplex AD#/AV# is the number assigned to the duplex of both strands in the same row of the table.

| Sense strand base sequence 5'→3' | SEQ ID NO | Antisense strand base sequence 5'→3' | SEQ ID NO | Duplex AD#/AV# |
|---|---|---|---|---|
| GCGUCAUCCACAAUGAGAGUA | 1 | UACUCUCAUUGUGGAUGACGC | 98 | AD00051 |
| GUCAUCCACAAUGAGAGUACA | 2 | UGUACUCUCAUUGUGGAUGAC | 99 | AD00052 |
| GAUCCACAAUGAGAGUACCUA | 3 | UAGGUACUCUCAUUGUGGAUC | 100 | AD00053 |
| GUCCACAAUGAGAGUACCUGA | 4 | UCAGGUACUCUCAUUGUGGAC | 101 | AD00054 |
| GUUCUUGGGCUUCCGUAUAUA | 5 | UAUAUACGGAAGCCCAAGAAC | 102 | AD00055 |
| GUUGGGCUUCCGUAUAUAUGA | 6 | UCAUAUAUACGGAAGCCCAAC | 103 | AD00056 |
| GUGGGCUUCCGUAUAUAUGGA | 7 | UCCAUAUAUACGGAAGCCCAC | 104 | AD00057 |
| GGCUUCCGUAUAUAUGGCAUA | 8 | UAUGCCAUAUAUACGGAAGCC | 105 | AD00058 |
| GCUUCCGUAUAUAUGGCAUGA | 9 | UCAUGCCAUAUAUACGGAAGC | 106 | AD00059 |
| GCGUAUAUAUGGCAUGCACAA | 10 | UUGUGCAUGCCAUAUAUACGC | 107 | AD00060 |
| GGUUCCUUGGAAGGACAAGAA | 11 | UUCUUGUCCUUCCAAGGAACC | 108 | AD00061 |
| GAGAAGAUUGACAGGUUCAUA | 12 | UAUGAACCUGUCAAUCUUCUC | 109 | AD00062 |
| GAUGCAGGCUGUGACAGGAUA | 13 | UAUCCUGUCACAGCCUGCAUC | 110 | AD00063 |
| GGAGUUCUGGGUGGACAACAA | 14 | UUGUUGUCCACCCAGAACUCC | 111 | AD00064 |

TABLE 1-continued

Antisense and sense strand sequences of unmodified AGT RNAi agents. All sequences are shown in the 5' to 3' direction. Duplex AD#/AV# is the number assigned to the duplex of both strands in the same row of the table.

| Sense strand base sequence 5'→3' | SEQ ID NO | Antisense strand base sequence 5'→3' | SEQ ID NO | Duplex AD#/AV# |
| --- | --- | --- | --- | --- |
| GCAACAGCACCUCAGUGUCUA | 15 | UAGACACUGAGGUGCUGUUGC | 112 | AD00065 |
| GGGGUCUCACUUUCCAGCAAA | 16 | UUUGCUGGAAAGUGAGACCCC | 113 | AD00066 |
| GUCACUUUCCAGCAAAACUCA | 17 | UGAGUUUUGCUGGAAAGUGAC | 114 | AD00067 |
| GCCAGCAAAACUCCCUCAACA | 18 | UGUUGAGGGAGUUUUGCUGGC | 115 | AD00068 |
| GAGCAAAACUCCCUCAACUGA | 19 | UCAGUUGAGGGAGUUUUGCUC | 116 | AD00069 |
| GGAGCUGAACCUGCAAAAAUA | 20 | UAUUUUUGCAGGUUCAGCUCC | 117 | AD00070 |
| GCUGAACCUGCAAAAAUUGAA | 21 | UUCAAUUUUUGCAGGUUCAGC | 118 | AD00071 |
| GGAACCGCCCAUUCCUGUUUA | 22 | UAAACAGGAAUGGGCGGUUCC | 119 | AD00072 |
| GAACCGCCCAUUCCUGUUUGA | 23 | UCAAACAGGAAUGGGCGGUUC | 120 | AD00073 |
| GUUCCUGUUUGCUGUGUAUGA | 24 | UCAUACACAGCAAACAGGAAC | 121 | AD00074 |
| GCUGUUUGCUGUGUAUGAUCA | 25 | UGAUCAUACACAGCAAACAGC | 122 | AD00075 |
| GUGUUUGCUGUGUAUGAUCAA | 26 | UUGAUCAUACACAGCAAACAC | 123 | AD00076 |
| GUUGCUGUGUAUGAUCAAAGA | 27 | UCUUUGAUCAUACACAGCAAC | 124 | AD00077 |
| GUCCCACCUUUUCUUCUAAUA | 28 | UAUUAGAAGAAAAGGUGGGAC | 125 | AD00078 |
| GACCUUUUCUUCUAAUGAGUA | 29 | UACUCAUUAGAAGAAAAGGUC | 126 | AD00079 |
| GCCUUUUCUUCUAAUGAGUCA | 30 | UGACUCAUUAGAAGAAAAGGC | 127 | AD00080 |
| GCGUUUCUCCUUGGUCUAAGA | 31 | UCUUAGACCAAGGAGAAACGC | 128 | AD00081 |
| GUUUCUCCUUGGUCUAAGUGA | 32 | UCACUUAGACCAAGGAGAAAC | 129 | AD00082 |
| GGUUUGCUGGGUUUAUUUUAA | 33 | UUAAAAUAAACCCAGCAAACC | 130 | AD00083 |
| GUUUGCUGGGUUUAUUUUAGA | 34 | UCUAAAAUAAACCCAGCAAAC | 131 | AD00084 |
| GUUGCUGGGUUUAUUUUAGAA | 35 | UUCUAAAAUAAACCCAGCAAC | 132 | AD00085 |
| GGGGUUUAUUUUAGAGAAUGA | 36 | UCAUUCUCUAAAAUAAACCCC | 133 | AD00086 |
| GGGUUUAUUUUAGAGAAUGGA | 37 | UCCAUUCUCUAAAAUAAACCC | 134 | AD00087 |
| GGGCAAGAACCAGUGUUUAGA | 38 | UCUAAACACUGGUUCUUGCCC | 135 | AD00088 |
| GGCAAGAACCAGUGUUUAGCA | 39 | UGCUAAACACUGGUUCUUGCC | 136 | AD00089 |
| GCAAGAACCAGUGUUUAGCGA | 40 | UCGCUAAACACUGGUUCUUGC | 137 | AD00090 |
| GCUGUUCCAAAAAGAAUUCCA | 41 | UGGAAUUCUUUUUGGAACAGC | 138 | AD00091 |
| GGUUCCAAAAAGAAUUCCAAA | 42 | UUUGGAAUUCUUUUUGGAACC | 139 | AD00092 |
| GUUCCAAAAAGAAUUCCAACA | 43 | UGUUGGAAUUCUUUUUGGAAC | 140 | AD00093 |
| GCAAAAAGAAUUCCAACCGAA | 44 | UUCGGUUGGAAUUCUUUUUGC | 141 | AD00094 |
| GAAAAAGAAUUCCAACCGACA | 45 | UGUCGGUUGGAAUUCUUUUUC | 142 | AD00095 |
| GCAACCGACCAGCUUGUUUGA | 46 | UCAAACAAGCUGGUCGGUUGC | 143 | AD00096 |
| GAACCGACCAGCUUGUUUGUA | 47 | UACAAACAAGCUGGUCGGUUC | 144 | AD00097 |
| GGACCAGCUUGUUUGUGAAAA | 48 | UUUUCACAAACAAGCUGGUCC | 145 | AD00098 |
| GACCAGCUUGUUUGUGAAACA | 49 | UGUUUCACAAACAAGCUGGUC | 146 | AD00099 |
| GCCAGCUUGUUUGUGAAACAA | 50 | UUGUUUCACAAACAAGCUGGC | 147 | AD00100 |

TABLE 1-continued

Antisense and sense strand sequences of unmodified AGT RNAi agents. All sequences are shown in the 5' to 3' direction. Duplex AD#/AV# is the number assigned to the duplex of both strands in the same row of the table.

| Sense strand base sequence 5'→3' | SEQ ID NO | Antisense strand base sequence 5'→3' | SEQ ID NO | Duplex AD#/AV# |
|---|---|---|---|---|
| GUCAUCCACAAUGAGAGUACA | 51 | UGUACUCUCAUUGUGGAUGAC | 148 | AD00101 |
| GUGGGCUUCCGUAUAUAUGGA | 52 | UCCAUAUAUACGGAAGCCCAC | 149 | AD00113 |
| GCUGUUUGCUGUGUAUGAUCA | 53 | UGAUCAUACACAGCAAACAGC | 150 | AD00114 |
| GGUUUGCUGGGUUUAUUUUAA | 54 | UUAAAAUAAACCCAGCAAACC | 151 | AD00115 |
| GCCAGCUUGUUUGUGAAACAA | 55 | UUGUUUCACAAACAAGCUGGC | 152 | AD00116 |
| GUCCCACCUUUUCUUCUAAUA | 56 | UAUUAGAAGAAAAGGUGGGAC | 153 | AD00122 |
| GCCUUUUCUUCUAAUGAGUCA | 57 | UGACUCAUUAGAAGAAAAGGC | 154 | AD00123 |
| GGGGUUUAUUUUAGAGAAUGA | 58 | UCAUUCUCUAAAAUAAACCCC | 155 | AD00124 |
| GGUUCCAAAAGAAUUCCAAA | 59 | UUUGGAAUUCUUUUUGGAACC | 156 | AD00125 |
| GUUCCAAAAGAAUUCCAACA | 60 | UGUUGGAAUUCUUUUUGGAAC | 157 | AD00126 |
| CAUCCACAAUGAGAGUACCUA | 61 | UAGGUACUCUCAUUGUGGAUG | 158 | AD00154 |
| CUUCUUGGGCUUCCGUAUAUA | 62 | UAUAUACGGAAGCCCAAGAAG | 159 | AD00155 |
| CAUGCAGGCUGUGACAGGAUA | 63 | UAUCCUGUCACAGCCUGCAUG | 160 | AD00156 |
| GCUGAACCUGCAAAAAUUGAA | 64 | UUCAAUUUUUGCAGGUUCAGC | 161 | AD00157 |
| CACCUUUUCUUCUAAUGAGUA | 65 | UACUCAUUAGAAGAAAAGGUG | 162 | AD00158 |
| CCGUUUCUCCUUGGUCUAAGA | 66 | UCUUAGACCAAGGAGAAACGG | 163 | AD00159 |
| ACUGUUCCAAAAAGAAUUCCA | 67 | UGGAAUUCUUUUUGGAACAGU | 164 | AD00160 |
| CAAAAAGAAUUCCAACCGACA | 68 | UGUCGGUUGGAAUUCUUUUUG | 165 | AD00161 |
| CGACCAGCUUGUUUGUGAAAA | 69 | UUUUCACAAACAAGCUGGUCG | 166 | AD00162 |
| GACCAGCUUGUUUGUGAAACA | 70 | UGUUUCACAAACAAGCUGGUC | 167 | AD00163 |
| UCGUCAUCCACAAUGAGAGUA | 71 | UACUCUCAUUGUGGAUGACGA | 168 | AD00252 |
| GUCCACAAUGAGAGUACCUGA | 72 | UCAGGUACUCUCAUUGUGGAC | 169 | AD00253 |
| AGGGUCUCACUUUCCAGCAAA | 73 | UUUGCUGGAAAGUGAGACCCU | 170 | AD00254 |
| CUGUUUGCUGUGUAUGAUCAA | 74 | UUGAUCAUACACAGCAAACAG | 171 | AD00255 |
| UUUGCUGUGUAUGAUCAAAGA | 75 | UCUUUGAUCAUACACAGCAAA | 172 | AD00256 |
| GUUUCUCCUUGGUCUAAGUGA | 76 | UCACUUAGACCAAGGAGAAAC | 173 | AD00257 |
| GCAAGAACCAGUGUUUAGCGA | 77 | UCGCUAAACACUGGUUCUUGC | 174 | AD00258 |
| CCAAAAGAAUUCCAACCGAA | 78 | UUCGGUUGGAAUUCUUUUUGG | 175 | AD00259 |
| CAACCGACCAGCUUGUUUGUA | 79 | UACAAACAAGCUGGUCGGUUG | 176 | AD00260 |
| GACCUUUUCUUCUAAUGAGUA | 80 | UACUCAUUAGAAGAAAAGGUC | 177 | AD00158-1 |
| GACCUUUCUUUCUAGCGAGUA | 81 | UACUCAUUAGAAGAAAAGGUC | 178 | AD00158-2 |
| GACCUUUUCUUCUAAUGAGUA | 82 | UACUCAUUAGAAGAAAAGGUC | 179 | AD00158-3 |
| CACCAGCUUGUUUGUGAAACA | 83 | UGUUUCACAAACAAGCUGGUG | 180 | AD00163-1 |
| CACCAGCUUGUUUGUGAAACA | 84 | UGUUUCACAAACAAGCUGGUG | 181 | AD00163-2 |
| GCGUUUCUCCUUGGUCUAAGA | 85 | UCUUAGACCAAGGAGAAACGC | 182 | AD00159-1 |
| GCGUUUCUCCUUGGUCUAAGA | 86 | UCUUAGACCAAGGAGAAACGC | 183 | AD00159-2 |
| GCAAAAAGAAUUCCAACCGAA | 87 | UUCGGUUGGAAUUCUUUUUGC | 184 | AD00300-1 |

TABLE 1-continued

Antisense and sense strand sequences of unmodified AGT RNAi agents. All sequences are shown in the 5' to 3' direction. Duplex AD#/AV# is the number assigned to the duplex of both strands in the same row of the table.

| Sense strand base sequence 5'→3' | SEQ ID NO | Antisense strand base sequence 5'→3' | SEQ ID NO | Duplex AD#/AV# |
|---|---|---|---|---|
| CCUUUCUUCUAAUGAGUA | 88 | UACUCAUUAGAAGAAAGG | 185 | AD00158-19-1 |
| CCAGCUUGUUUGUGAAACA | 89 | UGUUUCACAAACAAGCUGG | 186 | AD00163-19-1 |
| GUUUCUCCUUGGUCUAAGA | 90 | UCUUAGACCAAGGAGAAAC | 187 | AD00159-19-1 |
| AAAAGAAUUCCAACCGAA | 91 | UUCGGUUGGAAUUCUUUUU | 188 | AD00300-19-1 |
| CCCACCUUUUCUUCUAAUA | 92 | UAUUAGAAGAAAAGGUGGG | 189 | AD00122-19-1 |
| CCUUUCUUCUAAUGAGUU | 93 | AACUCAUUAGAAGAAAGG | 190 | AD00158-19-2 |
| CCAGCUUGUUUGUGAAACU | 94 | AGUUUCACAAACAAGCUGG | 191 | AD00163-19-2 |
| GUUUCUCCUUGGUCUAAGU | 95 | ACUUAGACCAAGGAGAAAC | 192 | AD00159-19-2 |
| AAAAGAAUUCCAACCGAU | 96 | AUCGGUUGGAAUUCUUUUU | 193 | AD00300-19-2 |
| CCCACCUUUUCUUCUAAUU | 97 | AAUUAGAAGAAAAGGUGGG | 194 | AD00122-19-2 |
| CACCAGCUUGUUUGUGAAACA | 522 | UGUUUCACAAACAAGCUGGUG | 523 | AD00163-3 |
| CACCAGCUUGUUUGUGAAACA | 528 | UGUUUCACAAACAAGCUGGUG | 559 | AV01227 |
| CACCAGCUUGUUUGUGAAACU | 529 | AGUUUCACAAACAAGCUGGUG | 560 | AV01228 |
| CACCAGCUUGUUUGUGAAACC | 530 | GGUUUCACAAACAAGCUGGUG | 561 | AV01229 |
| CACCAGCUUGUUUGUGAAACG | 531 | CGUUUCACAAACAAGCUGGUG | 562 | AV01230 |
| AGCUUGUUUGUGAAACA | 532 | UGUUUCACAAACAAGCU | 563 | AV01231 |
| CAGCUUGUUUGUGAAACA | 533 | UGUUUCACAAACAAGCUG | 564 | AV01232 |
| ACAGCUUGUUUGUGAAACA | 534 | UGUUUCACAAACAAGCUGU | 565 | AV01233 |
| UCAGCUUGUUUGUGAAACA | 535 | UGUUUCACAAACAAGCUGA | 566 | AV01234 |
| GCAGCUUGUUUGUGAAACA | 536 | UGUUUCACAAACAAGCUGC | 567 | AV01235 |
| CCAGCUUGUUUGUGAAACA | 537 | UGUUUCACAAACAAGCUGG | 568 | AV01236 |
| ACCAGCUUGUUUGUGAAACA | 538 | UGUUUCACAAACAAGCUGGU | 569 | AV01237 |
| UCCAGCUUGUUUGUGAAACA | 539 | UGUUUCACAAACAAGCUGGA | 570 | AV01238 |
| GCCAGCUUGUUUGUGAAACA | 540 | UGUUUCACAAACAAGCUGGC | 571 | AV01239 |
| CCCAGCUUGUUUGUGAAACA | 541 | UGUUUCACAAACAAGCUGGG | 572 | AV01240 |
| GACCAGCUUGUUUGUGAAACA | 542 | UGUUUCACAAACAAGCUGGUC | 573 | AV01241 |
| AACCAGCUUGUUUGUGAAACA | 543 | UGUUUCACAAACAAGCUGGUU | 574 | AV01242 |
| UACCAGCUUGUUUGUGAAACA | 544 | UGUUUCACAAACAAGCUGGUA | 575 | AV01243 |
| CGACCAGCUUGUUUGUGAAACA | 545 | UGUUUCACAAACAAGCUGGUCG | 576 | AV01244 |
| CCGACCAGCUUGUUUGUGAAACA | 546 | UGUUUCACAAACAAGCUGGUCGG | 577 | AV01245 |
| ACCGACCAGCUUGUUUGUGAAACA | 547 | UGUUUCACAAACAAGCUGGUCGGU | 578 | AV01246 |
| AACCGACCAGCUUGUUUGUGAAACA | 548 | UGUUUCACAAACAAGCUGGUCGGUU | 579 | AV01247 |
| CAACCGACCAGCUUGUUUGUGAAACA | 549 | UGUUUCACAAACAAGCUGGUCGGUUG | 580 | AV01248 |
| GAAUUCCAACCGACCAGCUUGUUUGUGAAACA | 550 | UGUUUCACAAACAAGCUGGUCGGUUGGAAUUC | 581 | AV01249 |
| CACCAGCUUGUUUGUGAAACA | 551 | UGUUUCACAAACAAGCUGGUGUU | 582 | AV01250 |
| CACCAGCUUGUUUGUGAAACA | 552 | UGUUUCACAAACAAGCUGGUGGA | 583 | AV01251 |

TABLE 1-continued

Antisense and sense strand sequences of unmodified AGT RNAi agents. All sequences are shown in the 5' to 3' direction. Duplex AD#/AV# is the number assigned to the duplex of both strands in the same row of the table.

| Sense strand base sequence 5'→3' | SEQ ID NO | Antisense strand base sequence 5'→3' | SEQ ID NO | Duplex AD#/ AV# |
|---|---|---|---|---|
| CACCAGCUUGUUUGUGAAACA | 553 | UGUUUCACAAACAAGCUGGUG | 584 | AV01252 |
| CACCAGCUUGUUUGUGAAACA | 554 | UGUUUCACAAACAAGCUGGUG | 585 | AV01253 |
| CACCAGCUUGUUUGUGAAACA | 555 | UGUUUCACAAACAAGCUGGUG | 586 | AV01254 |
| CACCAGCUUGUUUGUAAAACA | 556 | UGUUUCACAAACAAGCUGGUG | 587 | AV01255 |
| CACCAGCUUGUUUGUGAAAUA | 557 | UAUUUCACAAACAAGCUGGUG | 588 | AV01256 |
| CACCAGCUUGUUUGUGAAACA | 558 | UGUUUCACAAACAAGCUGGUG | 589 | AV01257 |
| CCAGCUUGUUUGUGAAAC | 652 | GUUUCACAAACAAGCUGG | 653 | AV01711 |

Table 2 shows the antisense and sense strand sequences of certain chemically modified AGT RNAi agents of the invention. In some embodiments of the methods of the invention, an RNAi agent having the polynucleotide sequence shown in Table 2 is administered to the cell and/or subject. In some embodiments of the methods of the invention, an RNAi agent having the polynucleotide sequence set forth in Table 2 is administered to the subject. In some embodiments of the invention, the RNAi agent administered to the subject comprises the duplexes noted in the first column of Table 2, and comprises the sequence modifications of sense and antisense strand sequences shown in the third and sixth columns of the same row in Table 2, respectively. In some embodiments of the methods of the invention, the sequences shown in Table 2 can be linked to (also referred to herein as "conjugated to") a compound capable of delivering an RNAi agent to cells and/or tissues of a subject. Non-limiting examples of delivery compounds useful in certain embodiments of the invention are GalNAc-containing compounds. In Table 2, the first column represents the duplex AD # or AV # of the base sequence, corresponding to Table 1. For the base sequence identified by AD # of the duplex, not only the base sequences contained in the sense and antisense strands are shown, but also the specified chemical modifications shown in the same row of Table 2. For example, the first row of Table 1 shows the single-stranded sense and antisense base sequences, which together form a duplex, identified as: duplex AD #AD00051; whereas, in the duplex AD #AD00051 listed in table 2, as a duplex, it comprises the base sequences of AD00051-SS and AD00051-AS, and contains chemical modifications in the sense and antisense sequences shown in the third and sixth columns, respectively. "Sense strand SS #" in column 2 of Table 2 is the designated identifier for the sense sequence (including modifications) shown in column 3 in the same row. "Antisense Strand AS #" in the fifth column of Table 2 is the designated identifier for the antisense sequence (including modifications) shown in the sixth column.

TABLE 2

Antisense and sense strand sequences of chemically modified AGT RNAi agents are provided. All sequences are shown 5' to 3'. These sequences were used in some of the in vitro testing studies described herein. Chemical modifications are expressed as: upper case: 2'-fluoro; lower case: 2'-OMe; thiophosphate: *

| Duplex AD# | Sense strand SS# | Sense strand sequence | SEQ ID NO | Antisense strand AS# | Antisense strand sequence | SEQ ID NO |
|---|---|---|---|---|---|---|
| AD00051 | AD00051-SS | g*c*gucaucCaCaAugagagu*a | 195 | AD00051-AS | u*A*cucuCauugUgGaUgac*g*c | 245 |
| AD00053 | AD00053-SS | g*a*uccacaAuGaGaguaccu*a | 196 | AD00053-AS | u*A*gguaCucucAuUgUgga*u*c | 246 |
| AD00054 | AD00054-SS | g*u*ccacaaUgAgAguaccug*a | 197 | AD00054-AS | u*C*agguAcucuCaUuGugg*a*c | 247 |
| AD00055 | AD00055-SS | g*u*ucuuggGcUuCcguauau*a | 198 | AD00055-AS | u*A*uauaCggaaGcCcAaga*a*c | 248 |
| AD00056 | AD00056-SS | g*u*ugggcuUcCgUauauaug*a | 199 | AD00056-AS | u*C*auauAuacgGaAgCcca*a*c | 249 |
| AD00057 | AD00057-SS | g*u*gggcuuCcGuAuauaugg*a | 200 | AD00057-AS | u*C*cauaUauacGgAaGccc*a*c | 250 |
| AD00058 | AD00058-SS | g*g*cuuccgUaUaUauggcau*a | 201 | AD00058-AS | u*A*ugccAuauaUaCgGaag*c*c | 251 |
| AD00059 | AD00059-SS | g*c*uuccguAuAuAuggcaug*a | 202 | AD00059-AS | u*C*augcCauauAuAcGgaa*g*c | 252 |
| AD00060 | AD00060-SS | g*c*guauauAuGgCaugcaca*a | 203 | AD00060-AS | u*U*gugcAugccAuAuAuac*g*c | 253 |
| AD00061 | AD00061-SS | g*g*uuccuuGgAaGgacaaga*a | 204 | AD00061-AS | u*U*cuugUccuuCcAaGgaa*c*c | 254 |
| AD00062 | AD00062-SS | g*a*gaagauUgAcAgguucau*a | 205 | AD00062-AS | u*A*ugaaCcuguCaAuCuuc*u*c | 255 |

TABLE 2-continued

Antisense and sense strand sequences of chemically modified AGT RNAi agents are provided. All sequences are shown 5' to 3'. These sequences were used in some of the in vitro testing studies described herein. Chemical modifications are expressed as: upper case: 2'-fluoro; lower case: 2'-OMe; thiophosphate: *

| Duplex AD# | Sense strand SS# | Sense strand sequence | SEQ ID NO | Antisense strand AS# | Antisense strand sequence | SEQ ID NO |
| --- | --- | --- | --- | --- | --- | --- |
| AD00063 | AD00063-SS | g*a*ugcaggCuGuGacaggau*a | 206 | AD00063-AS | u*A*uccuGucacAgCcUgca*u*c | 256 |
| AD00064 | AD00064-SS | g*g*aguucuGgGuGgacaaca*a | 207 | AD00064-AS | u*U*guugUccacCcAgAacu*c*c | 257 |
| AD00065 | AD00065-SS | g*c*aacagcAcCuCagugucu*a | 208 | AD00065-AS | u*A*gacaCugagGuGcUguu*g*c | 258 |
| AD00066 | AD00066-SS | g*g*ggucucAcUuUccagcaa*a | 209 | AD00066-AS | u*U*ugcuGgaaaGuGaGacc*c*c | 259 |
| AD00067 | AD00067-SS | g*u*cacuuuCcAgCaaaacuc*a | 210 | AD00067-AS | u*G*aguuUugcuGgAaAgug*a*c | 260 |
| AD00068 | AD00068-SS | g*c*cagcaaAaCuCccucaac*a | 211 | AD00068-AS | u*G*uugaGggagUuUuGcug*g*c | 261 |
| AD00069 | AD00069-SS | g*a*gcaaaaCuCcCucaacug*a | 212 | AD00069-AS | u*C*aguuGagggAgUuUugc*u*c | 262 |
| AD00070 | AD00070-SS | g*g*agcugaAcCuGcaaaaau*a | 213 | AD00070-AS | u*A*uuuuUgcagGuUcAgcu*c*c | 263 |
| AD00071 | AD00071-SS | g*c*ugaaccUgCaAaaauuga*a | 214 | AD00071-AS | u*U*caauUuuugCaGgUuca*g*c | 264 |
| AD00072 | AD00072-SS | g*g*aaccgcCcAuUccuguuu*a | 215 | AD00072-AS | u*A*aacaGgaauGgCgGguu*c*c | 265 |
| AD00073 | AD00073-SS | g*a*accgccCaUuCcuguuug*a | 216 | AD00073-AS | u*C*aaacAggaaUgGcGgu*u*c | 266 |
| AD00074 | AD00074-SS | g*u*uccuguUuGcUguguaug*a | 217 | AD00074-AS | u*C*auacAcagcAaAcAgga*a*c | 267 |
| AD00075 | AD00075-SS | g*c*uguugcUgUgUaugauc*a | 218 | AD00075-AS | u*G*aucaUacacAgCaAaca*g*c | 268 |
| AD00076 | AD00076-SS | g*u*guuugcUgUgUaugauca*a | 219 | AD00076-AS | u*U*gaucAuacaCaGcAaac*a*c | 269 |
| AD00077 | AD00077-SS | g*u*ugcuguGuAuGaucaaag*a | 220 | AD00077-AS | u*C*uuugAucauAcAcAgca*a*c | 270 |
| AD00078 | AD00078-SS | g*u*cccaccUuUuCuucuaau*a | 221 | AD00078-AS | u*A*uuagAagaaAaGgUggg*a*c | 271 |
| AD00079 | AD00079-SS | g*a*ccuuuuCuUcUaaugagu*a | 222 | AD00079-AS | u*A*cucaUuagaAgAaAagg*u*c | 272 |
| AD00080 | AD00080-SS | g*c*cuuuucUuCuAaugaguc*a | 223 | AD00080-AS | u*G*acucAuuagAaGaAaag*g*c | 273 |
| AD00081 | AD00081-SS | g*c*guuucuCcUuGgucuaag*a | 224 | AD00081-AS | u*C*uuagAccaaGgAgAaac*g*c | 274 |
| AD00082 | AD00082-SS | g*u*uucuccUuGgUcuaagug*a | 225 | AD00082-AS | u*C*acuuAgaccAaGgAgaa*a*c | 275 |
| AD00083 | AD00083-SS | g*g*uuugcuGgGuUauuuua*a | 226 | AD00083-AS | u*U*aaaaUaaacCcAgCaaa*c*c | 276 |
| AD00084 | AD00084-SS | g*u*uugcugGgUuUauuuuag*a | 227 | AD00084-AS | u*C*uaaaAuaaaCcCaGcaa*a*c | 277 |
| AD00085 | AD00085-SS | g*u*ugcuggGuUuAuuuuaga*a | 228 | AD00085-AS | u*U*cuaaAauaaAcCcAgca*a*c | 278 |
| AD00086 | AD00086-SS | g*g*gguuaUuUuAgagaaug*a | 229 | AD00086-AS | u*C*auucUcuaaAaUaAacc*c*c | 279 |
| AD00087 | AD00087-SS | g*g*guuuauUuUaGagaaugg*a | 230 | AD00087-AS | u*C*cauuCucuaAaAuAaac*c*c | 280 |
| AD00088 | AD00088-SS | g*g*gcaagaAcCaGuguuuag*a | 231 | AD00088-AS | u*C*uaaaCacugGuUcUugc*c*c | 281 |
| AD00089 | AD00089-SS | g*g*caagaaCcAgUguuuagc*a | 232 | AD00089-AS | u*G*cuaaAcacuGgUuCuug*g*c | 282 |
| AD00090 | AD00090-SS | g*c*aagaacCaGuGuuuagcg*a | 233 | AD00090-AS | u*C*gcuaAacacUgGuUcuu*g*c | 283 |
| AD00091 | AD00091-SS | g*c*uguccAaAaAgaauucc*a | 234 | AD00091-AS | u*G*gaauUcuuuUuGgAaca*g*c | 284 |
| AD00092 | AD00092-SS | g*g*uuccaaAaAgAauuccaa*a | 235 | AD00092-AS | u*U*uggaAuucuUuUuGgaa*c*c | 285 |
| AD00093 | AD00093-SS | g*u*uccaaaAaGaAuuccaac*a | 236 | AD00093-AS | u*G*uuggAauucUuUuUgga*a*c | 286 |
| AD00094 | AD00094-SS | g*c*aaaaagAaUuCcaaccga*a | 237 | AD00094-AS | u*U*cgguUggaaUuCuUuu*u*g*c | 287 |
| AD00095 | AD00095-SS | g*a*aaaagaAuUcCaaccgac*a | 238 | AD00095-AS | u*G*ucggUuggaAuUcUuuu*u*c | 288 |
| AD00096 | AD00096-SS | g*c*aaccgaCcAgCuuguuug*a | 239 | AD00096-AS | u*C*aaacAagcuGgUcGguu*g*c | 289 |
| AD00097 | AD00097-SS | g*a*accgacCaGcUuguuugu*a | 240 | AD00097-AS | u*A*caaaCaagcUgGuCggu*u*c | 290 |

TABLE 2-continued

Antisense and sense strand sequences of chemically modified AGT RNAi agents are provided. All sequences are shown 5' to 3'. These sequences were used in some of the in vitro testing studies described herein. Chemical modifications are expressed as: upper case: 2'-fluoro; lower case: 2'-OMe; thiophosphate: *

| Duplex AD# | Sense strand SS# | Sense strand sequence | SEQ ID NO | Antisense strand AS# | Antisense strand sequence | SEQ ID NO |
|---|---|---|---|---|---|---|
| AD00098 | AD00098-SS | g*g*accagcUuGuUugugaaa*a | 241 | AD00098-AS | u*U*uucaCaaacAaGcUggu*c*c | 291 |
| AD00099 | AD00099-SS | g*a*ccagcUuGuUugugaaac*a | 242 | AD00099-AS | u*G*uuucAcaaaCaAgCugg*u*c | 292 |
| AD00100 | AD00100-SS | g*c*cagcuuGuUuGugaaaca*a | 243 | AD00100-AS | u*U*guuuCacaaAcAaGcug*g*c | 293 |
| AD00101 | AD00101-SS | g*u*cauccaCaAuGagaguac*a | 244 | AD00101-AS | u*G*uacuCucauUgUgGaug*a*c | 294 |
| AV01227 | AV01227-SS | c*a*ccagcUgUuUgugaaac*a | 590 | AV01227-AS | u*G*uuucAcaaaCaAgCugg*u*g | 621 |
| AV01228 | AV01228-SS | c*a*ccagcUgUuUgugaaac*u | 591 | AV01228-AS | a*G*uuucAcaaaCaAgCugg*u*g | 622 |
| AV01229 | AV01229-SS | c*a*ccagcUgUuUgugaaac*c | 592 | AV01229-AS | g*G*uuucAcaaaCaAgCugg*u*g | 623 |
| AV01230 | AV01230-SS | c*a*ccagcUgUuUgugaaac*g | 593 | AV01230-AS | c*G*uuucAcaaaCaAgCugg*u*g | 624 |
| AV01231 | AV01231-SS | a*g*cuUgUuUgugaaac*a | 594 | AV01231-AS | u*G*uuucAcaaaCaAg*C*u | 625 |
| AV01232 | AV01232-SS | c*a*gcuUgUuUgugaaac*a | 595 | AV01232-AS | u*G*uuucAcaaaCaAgC*u*g | 626 |
| AV01233 | AV01233-SS | a*c*agcuUgUuUgugaaac*a | 596 | AV01233-AS | u*G*uuucAcaaaCaAgCu*g*u | 627 |
| AV01234 | AV01234-SS | u*c*agcuUgUuUgugaaac*a | 597 | AV01234-AS | u*G*uuucAcaaaCaAgCu*g*a | 628 |
| AV01235 | AV01235-SS | g*c*agcuUgUuUgugaaac*a | 598 | AV01235-AS | u*G*uuucAcaaaCaAgCu*g*c | 629 |
| AV01236 | AV01236-SS | c*c*agcuUgUuUgugaaac*a | 599 | AV01236-AS | u*G*uuucAcaaaCaAgCu*g*g | 630 |
| AV01237 | AV01237-SS | a*c*cagcuUgUuUgugaaac*a | 600 | AV01237-AS | u*G*uuucAcaaaCaAgCug*g*u | 631 |
| AV01238 | AV01238-SS | u*c*cagcuUgUuUgugaaac*a | 601 | AV01238-AS | u*G*uuucAcaaaCaAgCug*g*a | 632 |
| AV01239 | AV01239-SS | g*c*cagcuUgUuUgugaaac*a | 602 | AV01239-AS | u*G*uuucAcaaaCaAgCug*g*c | 633 |
| AV01240 | AV01240-SS | c*c*cagcuUgUuUgugaaac*a | 603 | AV01240-AS | u*G*uuucAcaaaCaAgCug*g*g | 634 |
| AV01241 | AV01241-SS | g*a*ccagcuUgUuUgugaaac*a | 604 | AV01241-AS | u*G*uuucAcaaaCaAgCugg*u*c | 635 |
| AV01242 | AV01242-SS | a*a*ccagcuUgUuUgugaaac*a | 605 | AV01242-AS | u*G*uuucAcaaaCaAgCugg*u*u | 636 |
| AV01243 | AV01243-SS | u*a*ccagcuUgUuUgugaaac*a | 606 | AV01243-AS | u*G*uuucAcaaaCaAgCugg*u*a | 637 |
| AV01244 | AV01244-SS | c*g*accagcuUgUuUgugaaac*a | 607 | AV01244-AS | u*G*uuucAcaaaCaAgCuggu*c*g | 638 |
| AV01245 | AV01245-SS | c*c*gaccagcuUgUuUgugaaac*a | 608 | AV01245-AS | u*G*uuucAcaaaCaAgCugguc*g*g | 639 |
| AV01246 | AV01246-SS | a*c*cgaccagcuUgUuUgugaaac*a | 609 | AV01246-AS | u*G*uuucAcaaaCaAgCuggucg*g*u | 640 |
| AV01247 | AV01247-SS | a*a*ccgaccagcuUgUuUgugaaac*a | 610 | AV01247-AS | u*G*uuucAcaaaCaAgCuggucgg*u*u | 641 |
| AV01248 | AV01248-SS | c*a*accgaccagcuUgUuUgugaaac*a | 611 | AV01248-AS | u*G*uuucAcaaaCaAgCuggucggu*u*g | 642 |
| AV01249 | AV01249-SS | g*a*auccaaccgaccagcuUgUuUgugaaac*a | 612 | AV01249-AS | u*G*uuucAcaaaCaAgCuggucgguggaau*u*c | 643 |
| AV01250 | AV01250-SS | c*a*ccagcuUgUuUgugaaac*a | 613 | AV01250-AS | u*G*uuucAcaaaCaAgCuggug*u*u | 644 |
| AV01251 | AV01251-SS | c*a*ccagcuUgUuUgugaaac*a | 614 | AV01251-AS | u*G*uuucAcaaaCaAgCuggug*g*a | 645 |
| AV01252 | AV01252-SS | c*a*ccagcuUgUuUgugaaac*a | 615 | AV01252-AS | u*G*uuu(cUNA)AcaaaCaAgCug g*u*g | 646 |
| AV01253 | AV01253-SS | c*a*ccagcuUgUuUgugaaac*a | 616 | AV01253-AS | u*G*uuuc(aUNA)caaaCaAgCug g*u*g | 647 |

TABLE 2-continued

Antisense and sense strand sequences of chemically modified AGT RNAi agents are provided. All sequences are shown 5' to 3'. These sequences were used in some of the in vitro testing studies described herein. Chemical modifications are expressed as: upper case: 2'-fluoro; lower case: 2'-OMe; thiophosphate: *

| Duplex AD# | Sense strand SS# | Sense strand sequence | SEQ ID NO | Antisense strand AS# | Antisense strand sequence | SEQ ID NO |
| --- | --- | --- | --- | --- | --- | --- |
| AV01254 | AV01254-SS | c*a*ccagcuUGUuugugaaac*a | 617 | AV01254-AS | u*G*uuuCacaaacaAgCugg*u*g | 648 |
| AV01255 | AV01255-SS | c*a*ccagcuUgUuUguaaaac*a | 618 | AV01255-AS | u*G*uuuCAcaaaCaAgCugg*u*g | 649 |
| AV01256 | AV01256-SS | c*a*ccagcuUgUuUgugaaau*a | 619 | AV01256-AS | u*A*uuuCAcaaaCaAgCugg*u*g | 650 |
| AV01257 | AV01257-SS | c*a*ccagcuUgUuUgugaaa*c*a | 620 | AV01257-AS | u*G*uuuCAcaaaCaAgCugg*u*g | 651 |

Table 3 shows the antisense and sense strand sequences of certain chemically modified AGT RNAi agents of the invention. In some embodiments of the methods of the invention, RNAi agents shown in Table 3 are administered to a cell and/or subject. In some embodiments of the methods of the invention, an RNAi agent having the polynucleotide sequence set forth in Table 3 is administered to a subject. In some embodiments of the invention, the RNAi agent administered to the subject comprises a duplex identified in the first column of Table 3, and includes the sequence modifications and/or delivery compound shown in the sense and antisense strand sequences in the third and sixth columns, respectively, of the same row of Table 3. The sequences were used in certain in vivo testing studies described elsewhere herein. In some embodiments of the methods of the invention, the sequences shown in Table 3 can be linked (also referred to herein as "conjugated") to a compound for delivery, a non-limiting example of which is a GalNAc-containing compound, that is, a delivery compound identified as "GLX-n" is present on the sense strand in the third column of Table 3. As used herein, "GLX" is used to mean a "GLS" or "GLO" delivery compound ("X" can be "S" or "O"), and GLX-n can be any GLS and GLO that can be linked to the 3' or 5-end of an oligonucleotide of the invention during the synthesis process. As a non-limiting example, GLX-13 and GLX-14 can be connected to the 3'-end of an oligonucleotide of the present invention during the synthesis process, and GLX-5 and GLX-15 can be connected to the 5'-end of an oligonucleotide of the present invention during the synthesis process. In some embodiments, as used herein and as shown in Table 3, "GLX-n" is used to represent the attached GalNAc-containing compound, and is any of the compounds GLS-1, GLS-2, GLS-3, GLS-4, GLS-5, GLS-6, GLS-7, GLS-8, GLS-9, GLS-10, GLS-11, GLS-12, GLS-13, GLS-14, GLS-15, GLS-16, GLO-1, GLO-2, GLO-3, GLO-4, GLO-5, GLO-6, GLO-7, GLO-8, GLO-9, GLO-10, GLO-11, GLO-12, GLO-13, GLO-14, GLO-15 and GLO-16. In some implementations, GLO-0 represents a GalNAc-containing compound that has been disclosed in the prior art as usable for ligation, such as, but not limited to, the GalNAc-containing compounds useful for ligation disclosed in Jayaprakash, et al., (2014) *J. Am. Chem. Soc.,* 136, 16958, all of which are cited herein. In some implementations, one skilled in the art will be able to prepare and use dsRNA compounds of the invention with attached delivery compounds including, but not limited to: GLS-1, GLS-2, GLS-3, GLS-4, GLS-5, one of GLS-6, GLS-7, GLS-8, GLS-9, GLS-10, GLS-11, GLS-12, GLS-13, GLS-14, GLS-15, GLS-16, GLO-1, GLO-2, GLO-3, GLO-4, GLO-5, GLO-6, GLO-7, GLO-8, GLO-9, GLO-10, GLO-11, GLO-12, GLO-13, GLO-14, GLO-15 and GLO-16. The structure of each of these is provided elsewhere herein. The first column of Table 3 provides the duplex AD # of the duplex assigned to the sense and antisense sequences in that row of the table. For example, duplex AD #AD00052 is a duplex composed of sense strand AD00052-SS and antisense strand AD00052-AS. Each row in Table 3 provides one sense strand and one antisense strand, and discloses the duplex constituted by the indicated sense strand and antisense strand. "Sense strand SS #" in the second column of Table 3 is the designated identifier for the sense sequence (including modifications) shown in column 3 of the same row. "Antisense Strand AS #" in the fifth column of Table 3 is the designated identifier for the antisense sequence (including modifications) shown in the sixth column. The identifier for certain linked GalNAc-containing GLO compounds is shown as GLO-0, and it should be understood that another of the GLO-n or GLS-n compounds may be substituted in place of the compound shown as GLO-0, and that the resulting compounds are also included in the embodiments of the methods and/or compositions of the invention.

TABLE 3 provides the antisense and sense strand sequences of the chemically modified AGT RNAi agents used for in vivo testing. All sequences are shown 5' to 3'. These sequences were used in some of the in vivo testing studies described elsewhere herein. The delivery molecules used in the in vivo studies are indicated as "GLO-0" at the 3' end of each sense strand. Chemical modifications are expressed as: upper case: 2'-fluoro; lower case: 2'-OMe; thiophosphate: *; unlocked nucleic acid: UNA (Note: AD00052, AD00113-AD00260: no UNA; AD00282-AD00301: UNA version)

| Duplex AD# | Sense strand SS# | Sense strand sequence | SEQ ID NO | Antisense strand AS# | Antisense strand sequence | SEQ ID NO |
|---|---|---|---|---|---|---|
| AD00052 | AD00052-SS | g*u*cauccaCaAuGagaguac*a(GLO-0) | 295 | AD00052-AS | u*G*uacuCucauUgGaug*a*c | 344 |
| AD00113 | AD00113-SS | g*u*gggcuuCcGuAuauaugg*a(GLO-0) | 296 | AD00113-AS | u*C*cauaUauacGgAaGccc*a*c | 345 |
| AD00114 | AD00114-SS | g*c*uguuugCuGuGuaugauc*a(GLO-0) | 297 | AD00114-AS | u*G*aucaUacacAgCaAaca*g*c | 346 |
| AD00115 | AD00115-SS | g*g*uuugcuGgGuUuauuuua*a(GLO-0) | 298 | AD00115-AS | u*U*aaaaUaaaccCcAgCaaa*c*c | 347 |
| AD00116 | AD00116-SS | g*c*cagcuuGuUuUgGugaaaca*a(GLO-0) | 299 | AD00116-AS | u*U*guuuCacaaAcAaGcug*g*c | 348 |
| AD00122 | AD00122-SS | g*u*cccaccUuUuCuucuauau*a(GLO-0) | 300 | AD00122-AS | u*A*uuagAagaaAaGgUggg*a*c | 349 |
| AD00123 | AD00123-SS | g*c*cuuuucUuCuAauagaguc*a(GLO-0) | 301 | AD00123-AS | u*G*acucAuuagAaGaAaag*g*c | 350 |
| AD00124 | AD00124-SS | g*g*gguuuaUuUuAgagaaug*a(GLO-0) | 302 | AD00124-AS | u*C*auucUcuaaAaUaAacc*c*c | 351 |
| AD00125 | AD00125-SS | g*g*uccaaaAaAgAauuccaa*a(GLO-0) | 303 | AD00125-AS | u*U*uggaAuucuUuUuGgaa*a*c | 352 |
| AD00126 | AD00126-SS | g*u*uccaaaaAaGaAuuccaac*a(GLO-0) | 304 | AD00126-AS | u*G*uuggAauucUuUuUgga*a*c | 353 |
| AD00154 | AD00154-SS | c*a*uccacaAuGaGaguaccu*a(GLO-0) | 305 | AD00154-AS | u*A*gguaCucucAuUgGuga*g*g | 354 |
| AD00155 | AD00155-SS | c*u*ucuuggGcUcCguauau*a(GLO-0) | 306 | AD00155-AS | u*A*uauaCgaaGcCcAaga*a*g | 355 |
| AD00156 | AD00156-SS | c*a*ugcaggCuGuGacaggau*a(GLO-0) | 307 | AD00156-AS | u*U*uccuGucacAgCcUgca*u*g | 356 |
| AD00157 | AD00157-SS | g*c*ugaaccUgCaAaaauuga*a(GLO-0) | 308 | AD00157-AS | u*U*caauUuuugCagGuuca*g*c | 357 |
| AD00158 | AD00158-SS | c*c*uuuuCuUcUaaugagu*a(GLO-0) | 309 | AD00158-AS | u*A*cucaUuagaAgAaAagg*u*g | 358 |
| AD00159 | AD00159-SS | c*c*guuucuCcUuGgucuaag*a(GLO-0) | 310 | AD00159-AS | u*C*uuagAccaaGgAgAaac*g*g | 359 |
| AD00160 | AD00160-SS | a*c*uguuccAaAaAgaauucc*a(GLO-0) | 311 | AD00160-AS | u*G*gaauUcuuuUuGgAaca*g*u | 360 |
| AD00161 | AD00161-SS | c*a*aaaagaAuUcCaaccgac*a(GLO-0) | 312 | AD00161-AS | u*G*ucggUuggaAuUcUuuu*u*g | 361 |
| AD00162 | AD00162-SS | c*g*accagcUuGuUuguguaa*a(GLO-0) | 313 | AD00162-AS | u*U*uucaCaaacAgCUggu*c*g | 362 |
| AD00163 | AD00163-SS | g*a*ccagcuUgUuUgugaaac*a(GLO-0) | 314 | AD00163-AS | u*G*uuucAcaaaCaAgCugg*u*c | 363 |
| AD00252 | AD00252-SS | u*c*gucaucCaCaAugagagu*a(GLO-0) | 315 | AD00252-AS | u*A*cucuCauugUgGaUgac*g*a | 364 |

TABLE 3-continued provides the antisense and sense strand sequences of the chemically modified AGT RNAi agents used for in vivo testing. All sequences are shown 5' to 3'. These sequences were used in some of the in vivo testing studies described elsewhere herein. The delivery molecules used in the in vivo studies are indicated as "GLO-0" at the 3' end of each sense strand. Chemical modifications are expressed as: upper case: 2'-fluoro; lower case: 2'-OMe; thiophosphate: *; unlocked nucleic acid: UNA (Note: AD00052, AD00113-AD00260: no UNA; AD00282-AD00301: UNA version)

| Duplex AD# | Sense strand SS# | Sense strand sequence | SEQ ID NO | Antisense strand AS# | Antisense strand sequence | SEQ ID NO |
|---|---|---|---|---|---|---|
| AD00253 | AD00253-SS | g*u*ccacaaUgAgAguaccug*a(GLO-0) | 316 | AD00253-AS | u*C*agguAcucuCaUuGugg*a*c | 365 |
| AD00254 | AD00254-SS | a*g*ggucucAcUuUccagcaa*a(GLO-0) | 317 | AD00254-AS | u*U*ugcuGgaaaGuGaGacc*c*u | 366 |
| AD00255 | AD00255-SS | c*u*guuugcUgUgUaugauca*a(GLO-0) | 318 | AD00255-AS | u*U*gaucAuacaCaGcAaac*a*g | 367 |
| AD00256 | AD00256-SS | u*u*ugcuguGuAuGaucaaag*a(GLO-0) | 319 | AD00256-AS | u*C*tuuugAucauAcAcAgca*a*a | 368 |
| AD00257 | AD00257-SS | g*u*uucucuUuGgUcuaagug*a(GLO-0) | 320 | AD00257-AS | u*C*acuuAgaccAaGgUcuu*g*c | 369 |
| AD00258 | AD00258-SS | g*c*aagaacCaGuGuuuagcg*a(GLO-0) | 321 | AD00258-AS | u*C*gcuaAacacUgGuUcuu*g*c | 370 |
| AD00259 | AD00259-SS | c*c*aaaaagAaUuCcaaccga*a(GLO-0) | 322 | AD00259-AS | u*U*cgguUggaaUuCuUuuu*g*g | 371 |
| AD00260 | AD00260-SS | c*a*accgacCaGcUuguuugu*a(GLO-0) | 323 | AD00260-AS | u*A*caaaCaagcUgGuCggu*u*g | 372 |
| AD00282 | AD00282-SS | g*u*ccaccUuUcUuucuaau*a(GLO-0) | 324 | AD00282-AS | u*A*uuAg(aUNA)agaaAaGgUggg*a*c | 373 |
| AD00283 | AD00283-SS | g*u*uccaaaAaGaAuuccaac*a(GLO-0) | 325 | AD00283-AS | u*G*uuGg(aUNA)auucUuUuUgga*a*c | 374 |
| AD00284 | AD00284-SS | g*c*cuuuucUuCuAaugaguc*a(GLO-0) | 326 | AD00284-AS | u*G*acUc(aUNA)uuagAgGaAaag*g*c | 375 |
| AD00285 | AD00285-SS | g*c*cagcuuGuUuGugaaaca*a(GLO-0) | 327 | AD00285-AS | u*U*guUu(cUNA)acaaAcAaGcug*g*c | 376 |
| AD00286 | AD00286-SS | g*u*uccaaAaAgAauuccaa*a(GLO-0) | 328 | AD00286-AS | u*U*ugGa(aUNA)ucuUuUuGgaa*c*c | 377 |
| AD00287 | AD00287-SS | g*g*uuugcUgGuUuauuuua*a(GLO-0) | 329 | AD00287-AS | u*U*aaAa(uUNA)aaacCcAgCaaa*c*c | 378 |
| AD00288 | AD00288-SS | c*a*ccuuuuCuUcUaaugagu*a(GLO-0) | 330 | AD00288-AS | u*A*cuCa(uUNA)uagaAgAaAagg*u*g | 379 |
| AD00289 | AD00289-SS | g*a*ccagcuUgUuUgaaaac*a(GLO-0) | 331 | AD00289-AS | u*G*uuUc(aUNA)caaaCaAgCugg*u*c | 380 |
| AD00290 | AD00290-SS | c*c*guuucuCcUuGgucuaag*a(GLO-0) | 332 | AD00290-AS | u*C*uuAg(aUNA)ccaaGgAgAaac*g*g | 381 |
| AD00291 | AD00291-SS | c*c*accagcUuGuUuguaa*a(GLO-0) | 333 | AD00291-AS | u*U*uuCa(cUNA)aaacAaGcUggu*c*g | 382 |
| AD00292 | AD00292-SS | c*a*aaaagaAuUcCaaccgac*a(GLO-0) | 334 | AD00292-AS | u*G*ucGg(uUNA)uggaAuUcUuuu*u*g | 383 |
| AD00293 | AD00293-SS | u*c*gucaucCaCaUgagagu*a(GLO-0) | 335 | AD00293-AS | u*A*cuCu(cUNA)auugUgGaUgac*g*a | 384 |
| AD00294 | AD00294-SS | g*u*ccacaaUgAgAguaccug*a(GLO-0) | 336 | AD00294-AS | u*C*agGu(aUNA)cucuCaUuGugg*a*c | 385 |
| AD00295 | AD00295-SS | a*g*ggucucAcUuUccagcaa*a(GLO-0) | 337 | AD00295-AS | u*U*ugCu(gUNA)gaaaGuGaGacc*c*u | 386 |

TABLE 3-continued provides the antisense and sense strand sequences of the chemically modified AGT RNAi agents used for in vivo testing. All sequences are shown 5' to 3'. These sequences were used in some of the in vivo testing studies described elsewhere herein. The delivery molecules used in the in vivo studies are indicated as "GLO-0" at the 3' end of each sense strand. Chemical modifications are expressed as: upper case: 2'-fluoro; lower case: 2'-OMe; thiophosphate: *; unlocked nucleic acid: UNA (Note: AD00052, AD00113-AD00260: no UNA; AD00282-AD00301: UNA version)

| Duplex AD# | Sense strand SS# | Sense strand sequence | SEQ ID NO | Antisense strand AS# | Antisense strand sequence | SEQ ID NO |
|---|---|---|---|---|---|---|
| AD00296 | AD00296-SS | c*u*guuugcUgUgUaugauca*a(GLO-0) | 338 | AD00296-AS | u*U*gaUc(aUNA)uacaCaGcAaac*a*g | 387 |
| AD00297 | AD00297-SS | u*u*ugcuguGuAuGaucaaag*a(GLO-0) | 339 | AD00297-AS | u*C*uuUg(aUNA)ucauAcAcAgca*a*a | 388 |
| AD00298 | AD00298-SS | g*u*uucuccUuGgUcuaagug*a(GLO-0) | 340 | AD00298-AS | u*C*acUu(aUNA)gaccAaGgAgaa*a*c | 389 |
| AD00299 | AD00299-SS | g*c*aagaacCaGuGuuuagcg*a(GLO-0) | 341 | AD00299-AS | u*C*gcUa(aUNA)acacUgGuUcuu*g*c | 390 |
| AD00300 | AD00300-SS | c*c*aaaaagAaUuCcaaccga*a(GLO-0) | 342 | AD00300-AS | u*U*cgGu(uUNA)ggaaUuCuUuuu*g*g | 391 |
| AD00301 | AD00301-SS | c*a*accgacCaGcUuguuugu*a(GLO-0) | 343 | AD00301-AS | u*A*caAa(cUNA)aagcUgGuCggu*u*g | 392 |
| AD00302 | AD00302-SS | c*c*aaccgaCcAgCuuguuug*a(GLO-0) | 524 | AD00302-AS | u*C*aaAc(aUNA)agcuggUcGguu*g*g | 525 |

Table 4 shows the antisense and sense strand sequences of certain chemically modified AGT RNAi agents of the invention. In some embodiments of the methods of the invention, an RNAi agent having the polynucleotide sequence set forth in Table 4 is administered to the subject. In some embodiments of the invention, the RNAi agent administered to the subject comprises a duplex identified in a row of the first column of Table 4, and includes the sequence modifications and/or delivery compound shown in the sense and antisense strand sequences in the same row in the third and sixth columns of Table 4. In some embodiments of the methods of the invention, the sequences shown in Table 4 can be linked to a compound capable of delivering the RNAi agent to cells and/or tissues of a subject. Non-limiting examples of delivery compounds useful in certain embodiments of the invention are GalNAc-containing compounds. In Table 4, the term "GLX-n" refers to compounds containing GalNAc in the sense strand shown. For example, the terms "GLO-0" and "GLS-5" each represent a different GalNAc-containing compound attached to the sense strand. It should be understood that a compound shown as GLO-0 may be substituted by another of the GLO-n or GLS-n compounds, and that the resulting compounds are also included in the embodiments of the methods and/or compositions of the present invention. Similarly, a compound shown as GLS-5 may also be substituted by another of the GLS-n or GLO-n compounds, and the resulting compounds included in the embodiments of the methods and/or compositions of the present invention. In Table 4, the compound GLX-n used to indicate the attached GalNAC-containing compound is compound GLS-1, GLS-2, GLS-3, GLS-4, GLS-5, GLS-6, GLS-7, GLS-8, GLS-9, GLS-10, GLS-11, GLS-12, GLS-13, GLS-14, GLS-15, GLS-16, GLO-1, GLO-2, GLO-3, GLO-4, GLO-5, GLO-6, GLO-7, GLO-8, GLO-9, GLO-10, GLO-11, GLO-12, GLO-13, GLO-14, GLO-15 and GLO-16, the structure of each of which is provided elsewhere herein. The first column of Table 4 represents the duplex AD # corresponding to the duplex shown in Table 3. The duplex AD # identifies the duplex sequence corresponding to Table 3, indicating that the sense, antisense, and duplex sequences in Table 4 are identical to the base sequence with the same duplex AD # in Table 3, but the sequences and duplexes in Table 4 have different chemical modifications and/or delivery compounds compared to the corresponding sequences and duplexes shown in Table 3. For example, as shown in Table 4, the sequences AD00113-1-SS and AD00113-1-AS and their duplex AD #AD00113-1 respectively have the same base sequence as AD00113-SS (sense), AD00113-AS (antisense) and double-stranded AD #AD00113 shown in Table 3, but with chemical modifications and/or delivery compounds as indicated in each table. The first column of Table 4 identifies the duplex AD # number; the duplexes identified by the numbers in each row comprise the sense and antisense strands shown in the third and sixth columns, respectively, in the same row, and include modifications, and each has a GLO- or GLS-delivery compound attached to the 3' or 5'-end of the sense strand.

TABLE 4 provides the antisense and sense strand sequences of chemically modified AGT RNAi agents. These sequences were used in certain in vivo studies described elsewhere herein. All sequences are shown 5' to 3'. Chemical modifications are indicated as: upper case: 2'-fluoro; lower case: 2'-OMe; thiophosphate: *; Invab = inverted abasic.

| Duplex AD# | Sense strand SS# | Sense strand sequence 5'→3' | SEQ ID NO | Antisense strand AS# | Antisense strand sequence 5'→3' | SEQ ID NO |
|---|---|---|---|---|---|---|
| AD00113-1 | AD00113-1-SS | (GLS-5)*(Invab)*gugggcuuCcGuAuauaugga*(Invab) | 393 | AD00113-1-AS | u*C*cauaUauacCgAaGccc*a*c | 456 |
| AD00114-1 | AD00114-1-SS | (GLS-5)*(Invab)*gcuguuugCuGuGuaugauca*(Invab) | 394 | AD00114-1-AS | u*G*aucaUacacAgCaAaca*g*c | 457 |
| AD00115-1 | AD00115-1-SS | (GLS-5)*(Invab)*ggguucuGgGuUuauuuuaa*(Invab) | 395 | AD00115-1-AS | u*U*aaaaUaaacCcAgCaaa*c*c | 458 |
| AD00116-1 | AD00116-1-SS | (GLS-5)*(Invab)*gccagcuuGuUuGugaaacaa*(Invab) | 396 | AD00116-1-AS | u*U*guuuCacaaaAcAaGcug*g*c | 459 |
| AD00122-1 | AD00122-1-SS | (GLS-5)*(Invab)*gucccaccUuUuCuucuaaua*(Invab) | 397 | AD00122-1-AS | u*A*uuagAagaaAaAgGUggg*a*c | 460 |
| AD00123-1 | AD00123-1-SS | (GLS-5)*(Invab)*gccuuuucUuCuAaugaguca*(Invab) | 398 | AD00123-1-AS | u*G*acucAuuagAaGaAaag*g*c | 461 |
| AD00124-1 | AD00124-1-SS | (GLS-5)*(Invab)*ggguuuaUuUuAgagaauga*(Invab) | 399 | AD00124-1-AS | u*C*auucUcuaaAaUaAacc*c*c | 462 |
| AD00125-1 | AD00125-1-SS | (GLS-5)*(Invab)*gguuccaaAaAgAauuccaaa*(Invab) | 400 | AD00125-1-AS | u*U*uggaAuucuUuUuGgaa*c*c | 463 |
| AD00126-1 | AD00126-1-SS | (GLS-5)*(Invab)*guuccaaaAaGaAauuccaaca*(Invab) | 401 | AD00126-1-AS | u*G*uggaAauucUuUuUgga*a*c | 464 |
| AD00154-1 | AD00154-1-SS | (GLS-5)*(Invab)*cauccacaAuGaGaguaccua*(Invab) | 402 | AD00154-1-AS | u*A*gguaCucucAuUgUgga*u*g | 465 |
| AD00155-1 | AD00155-1-SS | (GLS-5)*(Invab)*cuucuuggGcUuCcguauaua*(Invab) | 403 | AD00155-1-AS | u*A*uauaCggaaGcCcAaga*a*g | 466 |
| AD00156-1 | AD00156-1-SS | (GLS-5)*(Invab)*caugcaggCuGuGacaggaua*(Invab) | 404 | AD00156-1-AS | u*A*uccuGucaCagCcUgca*u*g | 467 |
| AD00157-1 | AD00157-1-SS | (GLS-5)*(Invab)*gcugaaccUgCaAaaaauuga*(Invab) | 405 | AD00157-1-AS | u*U*caauUuuugCaGgUuca*g*c | 468 |
| AD00160-1 | AD00160-1-SS | (GLS-5)*(Invab)*acuguuccAaAaAgaauucca*(Invab) | 406 | AD00160-1-AS | u*G*gaauUcuuuUuGgAaca*g*u | 469 |
| AD00161-1 | AD00161-1-SS | (GLS-5)*(Invab)*caaaaagaAuUcCaaccgaca*(Invab) | 407 | AD00161-1-AS | u*G*ucggUuggaAuUcUuuu*u*g | 470 |
| AD00162-1 | AD00162-1-SS | (GLS-5)*(Invab)*cgaccagcUuGuUugugaaaa*(Invab) | 408 | AD00162-1-AS | u*U*uucaCaaacAaGcUggu*c*g | 471 |
| AD00252-1 | AD00252-1-SS | (GLS-5)*(Invab)*ucgucaucCaCaAugagagua*(Invab) | 409 | AD00252-1-AS | u*A*cucuCauugUgGaUgac*g*a | 472 |
| AD00253-1 | AD00253-1-SS | (GLS-5)*(Invab)*guccacaaUgAgaguaccuga*(Invab) | 410 | AD00253-1-AS | u*C*agguAcucuCaUuGugg*a*c | 473 |
| AD00254-1 | AD00254-1-SS | (GLS-5)*(Invab)*agggucucAcUuUccagcaaa*(Invab) | 411 | AD00254-1-AS | u*U*ugcuGgaaaGuGaGacc*c*u | 474 |
| AD00255-1 | AD00255-1-SS | (GLS-5)*(Invab)*cuguuugcUgUgUaugaucaa*(Invab) | 412 | AD00255-1-AS | u*U*gaucAuacaCaGcAaac*a*g | 475 |
| AD00256-1 | AD00256-1-SS | (GLS-5)*(Invab)*uuugcuguGuAuGaucaaaga*(Invab) | 413 | AD00256-1-AS | u*C*uuugAucauAcAcAgca*a*a | 476 |
| AD00257-1 | AD00257-1-SS | (GLS-5)*(Invab)*guuucuccUuGgUcuaaguga*(Invab) | 414 | AD00257-1-AS | u*C*acuuAgaccAaGgaa*a*c | 477 |

TABLE 4-continued provides the antisense and sense strand sequences of chemically modified AGT RNAi agents. These sequences were used in certain in vivo studies described elsewhere herein. All sequences are shown 5' to 3'. Chemical modifications are indicated as: upper case: 2'-OMe; lower case: 2'-fluoro; *: thiophosphate; Invab = inverted abasic.

| Duplex AD# | Sense strand SS# | Sense strand sequence 5'→3' | SEQ ID NO | Antisense strand AS# | Antisense strand sequence 5'→3' | SEQ ID NO |
|---|---|---|---|---|---|---|
| AD00258-1 | AD00258-1-SS | (GLS-5)*(Invab)*gcaagaacCaGuGuuuagcga*(Invab) | 415 | AD00258-1-AS | u*C*gcuaAacacUgGuUcuu*g*c | 478 |
| AD00259-1 | AD00259-1-SS | (GLS-5)*(Invab)*ccaaaaagAaUuCcaaccgaa*(Invab) | 416 | AD00259-1-AS | u*U*cgguUggaaUuCuUuuu*g*g | 479 |
| AD00260-1 | AD00260-1-SS | (GLS-5)*(Invab)*caaccgacCaGcUuguuugua*(Invab) | 417 | AD00260-1-AS | u*A*caaaCaagcUgGuCggu*u*g | 480 |
| AD00282-1 | AD00282-1-SS | (GLS-5)*(Invab)*gucccaccUuUuCuuccuaua*(Invab) | 418 | AD00282-1-AS | u*A*uuAg(aUNA)agaaAaGgUggg*a*c | 481 |
| AD00283-1 | AD00283-1-SS | (GLS-5)*(Invab)*gauccaaaAaGaAuuccaaca*(Invab) | 419 | AD00283-1-AS | u*G*uuGg(aUNA)auucUuUuUgga*a*c | 482 |
| AD00284-1 | AD00284-1-SS | (GLS-5)*(Invab)*gcuuuuucUuCuAaugagca*(Invab) | 420 | AD00284-1-AS | u*G*acUc(aUNA)uuagAaGaAaag*g*c | 483 |
| AD00285-1 | AD00285-1-SS | (GLS-5)*(Invab)*gccagcuuGuUuGugaaacaa*(Invab) | 421 | AD00285-1-AS | u*U*guUu(cUNA)acaaAcAaGcug*g*c | 484 |
| AD00286-1 | AD00286-1-SS | (GLS-5)*(Invab)*ggauccaaAaAgAauuccaaa*(Invab) | 422 | AD00286-1-AS | u*U*ugGa(aUNA)uucuUuUugaa*c*c | 485 |
| AD00287-1 | AD00287-1-SS | (GLS-5)*(Invab)*gguuugcuGgGuUauuuuaa*(Invab) | 423 | AD00287-1-AS | u*U*aaAa(uUNA)aaacCcAgCaaa*c*c | 486 |
| AD00288-1 | AD00288-1-SS | (GLS-5)*(Invab)*caccuuuuCuUcUaaugagua*(Invab) | 424 | AD00288-1-AS | u*A*cuCa(uUNA)uagaAgAaAagg*u*g | 487 |
| AD00289-1 | AD00289-1-SS | (GLS-5)*(Invab)*gaccagcuGuUuUgugaaaca*(Invab) | 425 | AD00289-1-AS | u*G*uuUc(aUNA)caaaCaAgCugg*u*c | 488 |
| AD00290-1 | AD00290-1-SS | (GLS-5)*(Invab)*ccguuucuCcUuGgucuaaga*(Invab) | 426 | AD00290-1-AS | u*U*uuAg(aUNA)ccaaGgAgAaac*g*g | 489 |
| AD00291-1 | AD00291-1-SS | (GLS-5)*(Invab)*cgaccagcUuGuUuguaaaa*(Invab) | 427 | AD00291-1-AS | u*U*uuCa(cUNA)aaacAaGcUggu*c*g | 490 |
| AD00292-1 | AD00292-1-SS | (GLS-5)*(Invab)*caaaagaAuUcCaaccgaca*(Invab) | 428 | AD00292-1-AS | u*G*ucGg(uUNA)uggaAuUcUuuu*u*g | 491 |
| AD00293-1 | AD00293-1-SS | (GLS-5)*(Invab)*ucgucaucCaCaAugagagua*(Invab) | 429 | AD00293-1-AS | u*A*cuCu(cUNA)auugUgGaUgac*g*a | 492 |
| AD00294-1 | AD00294-1-SS | (GLS-5)*(Invab)*guccacaaUgAgAguaccuga*(Invab) | 430 | AD00294-1-AS | u*C*agGu(aUNA)cucuCaUuGugg*a*c | 493 |
| AD00295-1 | AD00295-1-SS | (GLS-5)*(Invab)*agggucucAcUuUccagcaaa*(Invab) | 431 | AD00295-1-AS | u*U*ugCu(gUNA)gaaaGuGaGacc*c*u | 494 |
| AD00296-1 | AD00296-1-SS | (GLS-5)*(Invab)*cuguuugcUgUgUaugaucaa*(Invab) | 432 | AD00296-1-AS | u*U*gaUc(aUNA)uacaCaGcAaac*a*g | 495 |
| AD00297-1 | AD00297-1-SS | (GLS-5)*(Invab)*uuugugcuGuAuGaucaaaga*(Invab) | 433 | AD00297-1-AS | u*C*uuUg(aUNA)ucauAcAcAgca*a*a | 496 |
| AD00298-1 | AD00298-1-SS | (GLS-5)*(Invab)*guuucccUugGuUcuaaguga*(Invab) | 434 | AD00298-1-AS | u*C*acUu(aUNA)gaccAaGgAgaa*a*c | 497 |
| AD00299-1 | AD00299-1-SS | (GLS-5)*(Invab)*gcaagaacCaGuGuuuagcga*(Invab) | 435 | AD00299-1-AS | u*C*gcUa(aUNA)acacUgGuUcuu*g*c | 498 |
| AD00301-1 | AD00301-1-SS | (GLS-5)*(Invab)*caaccgacCaGcUuguuugua*(Invab) | 436 | AD00301-1-AS | u*A*caAa(cUNA)aagcUgGuCggu*u*g | 499 |
| AD00302-1 | AD00302-1-SS | (GLS-5)*(Invab)*ccaaccgaCcAgCuuguuuga*(Invab) | 437 | AD00302-1-AS | u*C*aaAc(aUNA)agcuggUcGguu*g*g | 500 |

TABLE 4-continued provides the antisense and sense strand sequences of chemically modified AGT RNAi agents. These sequences were used in certain in vivo studies described elsewhere herein. All sequences are shown 5' to 3'. Chemical modifications are indicated as: upper case: 2'-fluoro; lower case: 2'-OMe; thiophosphate: *; Invab = inverted abasic.

| Duplex AD# | Sense strand SS# | Sense strand sequence 5'→3' | SEQ ID NO | Antisense strand AS# | Antisense strand sequence 5'→3' | SEQ ID NO |
|---|---|---|---|---|---|---|
| AD00158-1 | AD00158-1-SS | (GLS-5)*(Invab)*gaccuuuuCuUcUaaugagua*(Invab) | 438 | AD00158-1-AS | u*A*cucaUuagaAgAaAagg*u*c | 501 |
| AD00158-2 | AD00158-2-SS | (GLS-5)*(Invab)*gaccuuucUuUcUagcgagua*(Invab) | 439 | AD00158-2-AS | u*A*cucaUuagaAgAaAagg*u*c | 502 |
| AD00158-3 | AD00158-3-SS | g*a*ccuuuuCuUcUaaugagu*a(GLO-0) | 440 | AD00158-3-AS | u*A*cucaUuagaAgAaAagg*u*c | 503 |
| AD00163-1 | AD00163-1-SS | (GLS-5)*(Invab)*caccagcuUgUuUgugaaaca*(Invab) | 441 | AD00163-1-AS | u*G*uuucAcaaaCaAgCugg*u*g | 504 |
| AD00163-2 | AD00163-2-SS | c*a*ccagcuUgUuUgugaaac*a(GLO-0) | 442 | AD00163-2-AS | u*G*uuucAcaaaCaAgCugg*u*g | 505 |
| AD00159-1 | AD00159-1-SS | (GLS-5)*(Invab)*gcguuucuCcUuGgucuaaga*(Invab) | 443 | AD00159-1-AS | u*C*uuagAccaaGgAgAac*g*c | 506 |
| AD00159-2 | AD00159-2-SS | g*c*guuucuCcUuGgucuaag*a(GLO-0) | 444 | AD00159-2-AS | u*C*uuagAccaaGgAgAaac*g*c | 507 |
| AD00300-1 | AD00300-1-SS | (GLS-5)*(Invab)*gcaaaaagAaUuCcaaccgaa*(Invab) | 445 | AD00300-1-AS | u*U*cgGu(uUNA)ggaaUuCuUuuu*g*c | 508 |
| AD00158-19-1 | AD00158-19-1-SS | (GLS-5)*(Invab)*ccuuuuCuUcUaaugagua*(Invab) | 446 | AD00158-19-1-AS | u*A*cucaUuagaAgAaAa*g*g | 509 |
| AD00163-19-1 | AD00163-19-1-SS | (GLS-5)*(Invab)*ccagcuUgUuUgugaaaca*(Invab) | 447 | AD00163-19-1-AS | u*G*uuucAcaaaCaAgCu*g*g | 510 |
| AD00159-19-1 | AD00159-19-1-SS | (GLS-5)*(Invab)*guuucuCcUuGgucuaaga*(Invab) | 448 | AD00159-19-1-AS | u*C*uuagAccaaGgAgAa*a*c | 511 |
| AD00300-19-1 | AD00300-19-1-SS | (GLS-5)*(Invab)*aaaaagAaUuCcaaccgaa*(Invab) | 449 | AD00300-19-1-AS | u*U*cgGu(uUNA)ggaaUuCuUu*u*u | 512 |
| AD00122-19-1 | AD00122-19-1-SS | (GLS-5)*(Invab)*cccaccUuUcUuucuaaua*(Invab) | 450 | AD00122-19-1-AS | u*A*uuagAagaaAaGgUg*g*g | 513 |
| AD00158-19-2 | AD00158-19-2-SS | (GLS-5)*(Invab)*ccuuuuCuUcUaaugaguu*(Invab) | 451 | AD00158-19-2-AS | a*A*cucaUuagaAgAaAa*g*g | 514 |

TABLE 4-continued provides the antisense and sense strand sequences of chemically modified AGT RNAi agents. These sequences were used in certain in vivo studies described elsewhere herein. All sequences are shown 5' to 3'. Chemical modifications are indicated as: upper case: 2'-fluoro; lower case: 2'-OMe; thiophosphate: *; Invab = inverted abasic.

| Duplex AD# | Sense strand SS# | Sense strand sequence 5'→3' | SEQ ID NO | Antisense strand AS# | Antisense strand sequence 5'→3' | SEQ ID NO |
|---|---|---|---|---|---|---|
| AD00163-19-2 | AD00163-19-2-SS | (GLS-5)*(Invab)*ccagcuUgUuUgugaaacu*(Invab) | 452 | AD00163-19-2-AS | a*G*uuucAcaaaCaAgCu*g*g | 515 |
| AD00159-19-2 | AD00159-19-2-SS | (GLS-5)*(Invab)*guuucuCcUuGgucuaagu*(Invab) | 453 | AD00159-19-2-AS | a*C*uuagAccaaGgAgAa*a*c | 516 |
| AD00300-19-2 | AD00300-19-2-SS | (GLS-5)*(Invab)*aaaaagAaUuCcaaccgau*(Invab) | 454 | AD00300-19-2-AS | a*U*cgGu(uUNA)ggaaUuCUu*u*u | 517 |
| AD00122-19-2 | AD00122-19-2-SS | (GLS-5)*(Invab)*cccaccUuUuCuucuaauu*(Invab) | 455 | AD00122-19-2-AS | a*A*uuagAagaaAaGgUg*g*g | 518 |
| AD00163-3 | AD00163-3-SS | (GLS-15)*(Invab)*caccagcuUgUuUgugaaaca*(Invab) | 526 | AD00163-3-AS | u*G*uuucAcaaaCaAgCugg*u*g | 527 |
| AD00159-3 | AD00159-3-SS | (GLS-15)*(Invab)*gcguuucuCcUuGgucuaaga*(Invab) | 654 | AD00159-3-AS | u*C*uuagAccaaGgAgAaac*g*c | 655 |

Mismatches

It is known to one skilled in the art that mismatches are tolerated for the efficacy of dsRNA, especially if they are within the terminal region of the dsRNA, Certain mismatches are better tolerated, such as those with wobble base pairs G:U and A:C (Du et al., A systematic analysis of the silencing effects of an active siRNA at all single-nucleotide mismatched target sites. *Nucleic Acids Res.* 2005 Mar. 21; 33 (5):1671-7. Doi: 10.1093/nar/gki312. *Nucleic Acids Res.* 2005; 33 (11):3698). In some embodiments of the methods and compounds of the invention, an AGT dsRNA agent may contain one or more mismatches to the AGT target sequence. In some embodiments, AGT dsRNA agents of the invention contain no mismatches. In certain embodiments, AGT dsRNA agents of the invention contain no more than 1 mismatch. In some embodiments, AGT dsRNA agents of the invention contain no more than 2 mismatches. In certain embodiments, AGT dsRNA agents of the invention contain no more than 3 mismatches. In some embodiments of the invention, the antisense strand of the AGT dsRNA agent contains a mismatch to the AGT target sequence that is not located in the center of the region of complementarity. In some embodiments, the antisense strand of the AGT dsRNA agent contains 1, 2, 3, 4, or more mismatches located within the last 5, 4, 3, 2 or 1 nucleotides from one or both of the 5' or 3' ends of the region of complementarity. Methods described herein and/or methods known in the art can be used to determine whether an AGT dsRNA agent containing a mismatch to an AGT target sequence is effective in inhibiting expression of the AGT gene.

Complementarity

As used herein, unless otherwise stated, the term "complementarity/complementary" when used to describe the relation of a first nucleotide sequence (e.g., AGT dsRNA agent sense strand or targeted AGT mRNA) to a second nucleotide sequence (e.g., AGT dsRNA agent antisense strand or single-stranded antisense polynucleotide), refers to the ability of an oligonucleotide or polynucleotide comprising the first nucleotide sequence to hybridize [form hydrogen bonds between base pairs under mammalian physiological conditions (or similar conditions in vitro)] with an oligonucleotide comprising the second nucleotide sequence, and form a double helix or duplex structure under certain conditions. Other conditions may also apply, such as physiologically relevant conditions that may be encountered in living organisms. One skilled in the art will be able to determine the set of conditions most suitable for testing the complementarity of two sequences based on the ultimate application of the hybridized nucleotides. Complementary sequences include Watson-Crick base pairs or non-Watson-Crick base pairs, and include natural or modified nucleotides or nucleotide mimics, at least to the extent that the above hybridization requirements are fulfilled. Sequence identity or complementarity is independent of modification.

For example, a complementary sequence within an AGT dsRNA as described herein comprises base-pairing of the oligonucleotide or polynucleotide comprising a first nucleotide sequence to the oligonucleotide or polynucleotide comprising a second nucleotide sequence over the entire length of one or both nucleotide sequences. Such sequences may be referred to herein as being "fully complementary" to each other. It should be understood that in embodiments where two oligonucleotides are designed to form one or more single-stranded overhangs upon hybridization, such overhangs are not considered herein to be mismatches determined based on complementarity. For example, an AGT dsRNA agent comprising one oligonucleotide that is 19 nucleotides in length and another oligonucleotide that is 20 nucleotides in length, where the longer oligonucleotide comprises a sequence of 19 nucleotides that is fully complementary to the shorter oligonucleotide, may for the purposes described herein, be referred to as "fully complementary". Thus, as used herein, "fully complementary" means that all (100%) of the bases in the contiguous sequence of a first polynucleotide will hybridize with the same number of bases in the contiguous sequence of a second polynucleotide. The contiguous sequence may comprise all or part of the first or second nucleotide sequence.

As used herein, the term "substantially complementary" means that in hybrid pairs of nucleobase sequences, at least about 85% (but not all) of the bases in a contiguous sequence of the first polynucleotide will hybridize with the same number of bases in a contiguous sequence of a second polynucleotide. If two sequences contain one or more mismatched base pairs when hybridized, for example at least 1, 2, 3, 4 or 5 mismatched base pairs, the term "substantially complementary" may be used in reference to a duplex of up to 15, 16, 17, 18, 19, 20, 21, 22, 23, 24, 25, 26, 27, 28, 29, or 30 base pairs (bp) formed by the first sequence with respect to the second sequence, while retaining the ability to hybridize under conditions most relevant to its end application, e.g., inhibition of AGT gene expression via a RISC pathway. The term "partially complementary" may be used herein to refer to a hybridized pair of nucleobase sequences in which at least 75% (but not all) of the bases in a contiguous sequence of a first polynucleotide will hybridize with the same number of bases in a contiguous sequence of a second polynucleotide. In some embodiments, "partially complementary" means at least 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% of the bases in a contiguous sequence of a first polynucleotide will hybridize with the same number of bases in a contiguous sequence of a second polynucleotide.

The terms "complementary", "fully complementary", "substantially complementary" and "partially complementary" may be used herein to refer to the base matching between the sense strand and the antisense strand of an AGT dsRNA agent, between the antisense strand of an AGT dsRNA agent and a sequence of a target AGT mRNA, or between a single-stranded antisense oligonucleotide and a sequence of a target AGT mRNA. It should be understood that the term "antisense strand of an AGT dsRNA agent" may refer to the same sequence of an "AGT antisense polynucleotide agent".

As used herein, the terms "substantially identical" or "substantial identity" when referring to a nucleic acid sequence means the nucleic acid sequence comprises a sequence that has at least about 85% or greater sequence identity with respect to a reference sequence, preferably at least 90%, at least 91%, at least 92%, at least 93%, at least 94%, at least 95%, at least 96%, at least 97%, at least 98% or at least 99%. Percentage of sequence identity is determined by comparing two optimally aligned of two sequences over a comparison window. The percentage is calculated by determining the number of positions where the same nucleic acid base occurs in both sequences to yield the number of matched positions, dividing the number of matched positions by the total number of positions in the comparison window, and multiplying the result by 100, to give percentage of sequence identity. The inventions disclosed herein include nucleotide sequences that are substantially identical to those disclosed herein (e.g., in Tables 1-5). In some embodiments, the nucleotide sequence is identical to, or at least about 85%, 86%, 87%, 88%, 89%, 90%, 91%, 92%, 93%, 94%, 95%, 96%, 97%, 98% or 99% identical to, a sequence disclosed herein (e.g., in Tables 1-4).

As used herein, the term "strand comprising a sequence" refers to an oligonucleotide comprising a strand of nucleotides described by the sequence referred to using standard nucleotide nomenclature. As used herein, the term "double-stranded RNA" or "dsRNA" refers to a sequence comprising an RNA molecule or a complex of RNAi molecules having a hybridized duplex region comprising two antiparallel and substantially or fully complementary nucleic acid strands, which are referred to as having "sense" and "antisense" orientations relative to a target AGT RNA. The duplex region can be of any desired length that allows specific degradation of the target AGT RNA by a RISC pathway, but is typically 9 to 30 base pairs in length, for example 15-30 base pairs in length. Considering a duplex between 9 and 30 base pairs, the duplex can be any length within this range, e.g., 9, 10, 11, 12, 13, 14, 15, 16, 17, 18, 19, 20, 21, 22, 23, 24, 25, 26, 27, 28, 29 or 30 base pairs, and any subrange therein, including but not limited to 15-30 base pairs, 15-26 base pairs; 15-23 base pairs, 15-22 base pairs, 15-21 base pairs, 15-20 base pairs, 15-19 base pairs, 15-18 base pairs, 15-17 base pairs, 18-30 base pairs, 18-26 base pairs, 18-23 base pairs, 18-22 base pairs, 18-21 base pairs, 18-20 base pairs, 19-30 base pairs, 19-26 base pairs, 19-23 base pairs, 19-22 base pairs, 19-21 base pairs, 19-20 base pairs, 20-30 base pairs, 20-26 base pairs, 20-25 base pairs, 20-24 base pairs, 20-23 base pairs, 20-22 base pairs, 20-21 base pairs, 21-30 base pairs, 21-26 base pairs, 21-25 base pairs, 21-24 base pairs, 21-23 base pairs, or 21-22 base pairs. AGT dsRNA agents generated in the cell by processing with Dicer and similar enzymes are typically in the range of 19-22 base pairs in length. One strand of the duplex region of an AGT dsDNA agent comprises a sequence that is substantially complementary to a region of a target AGT RNA. The two strands forming the duplex structure can come from a single RNA molecule having at least one self-complementary region, or can be formed from two or more separate RNA molecules. In the case where the duplex region is formed from a single molecule, the molecule may have a duplex structure formed between one strand at the 3'-end and another strand at the corresponding 5'-end of a single-stranded chain of nucleotides (herein referred to as a "hairpin loop"). In some embodiments of the invention, the hairpin configuration includes at least 1, 2, 3, 4, 5, 6, 7, 8, 9, 10, 11, 12, 13, 14, 15, 16, 17, 18, 19, or more unpaired nucleotides. When the two substantially complementary strands of an AGT dsRNA agent consist of separate RNA molecules, these molecules need not be covalently linked, but may be. When two strands are covalently connected by means other than a hairpin loop, the connecting structure is referred to as a "linker". The term "siRNA" is also used herein to refer to a dsRNA agent as described herein.

In some embodiments of the invention, AGT dsRNA agents can comprise sense and antisense sequences that have unpaired nucleotides or nucleotide analogues at one or both ends of the dsRNA agent. Ends without unpaired nucleotides are referred to as "blunt ends" and have no nucleotide overhangs. If both ends of the dsRNA agent are blunt, the dsRNA is said to be "blunt-ended". In some embodiments of the invention, a first end of the dsRNA agent is blunt, in some embodiments the second end of a dsRNA agent is blunt, and in certain embodiments of the invention, both ends of the AGT dsRNA agent are blunt.

In some embodiments of the dsRNA agents of the invention, the dsRNA does not have one or two blunt ends. In this case, there is at least one unpaired nucleotide at the end of a strand of the dsRNA agent. For example, when the 3'-end of one strand of dsRNA extends beyond the 5'-end of the other strand, or vice versa, there is a nucleotide overhang. A dsRNA can contain overhangs of at least 1, 2, 3, 4, 5, 6, or more nucleotides. Nucleotide overhangs may comprise or consist of nucleotide/nucleoside analogues, including deoxynucleotides/nucleosides. It should be understood that in some embodiments, nucleotide overhangs are on the sense strand of the dsRNA agent, on the antisense strand of the dsRNA agent, or at both ends of the dsRNA agent, and the nucleotide(s) of an overhang may be present on the 5' end, 3' end or both ends of either an antisense or sense strand of a dsRNA. In certain embodiments of the invention, one or more nucleotides in an overhang are replaced with a nucleoside thiophosphate.

As used herein, the term "antisense strand" or "guide strand" refers to the strand of an AGT dsRNA agent that includes a region that is substantially complementary to an AGT target sequence. As used herein, the term "sense strand" or "passenger strand" refers to a strand of an AGT dsRNA agent that contains a region that is substantially complementary to a region of the antisense strand of the AGT dsRNA agent.

Modifications

In some embodiments of the invention, the RNA of the AGT RNAi agent is chemically modified to obtain enhanced stability and/or one or more other beneficial properties. Nucleic acids in certain embodiments of the invention can be synthesized and/or modified by methods well known in the art, see for example, "Current protocols in Nucleic Acid Chemistry", Beaucage, S L et al. (Eds.), John Wiley & Sons, Inc., New York, NY, USA, which is hereby incorporated herein by reference. Modifications that may be present in certain embodiments of the AGT dsRNA agents of the invention include, for example: (a) terminal modifications, such as 5' end modifications (phosphorylation, conjugation, inverted linkages, etc.), 3' end modifications (conjugation, DNA nucleotides, inverted linkages, etc.); (b) base modifications, e.g. replacement with stabilizing bases, destabilizing bases or bases pairing with an expanded partner pool, missing bases (abasic nucleotides) or conjugated bases; (c) sugar modifications (e.g., at the 2' position or 4' position) or substitution of sugars; and (d) backbone modifications, including modification or replacement of the phosphodiester bonds. Specific examples of RNA compounds useful in certain embodiments of the AGT dsRNA agents, AGT antisense polynucleotides, and AGT sense polynucleotides of the invention include, but are not limited to, RNAs comprising modified backbones or lacking natural internucleoside linkages. As a non-limiting example, an RNA with backbone modifications may not have a phosphorus atoms in the backbone. An RNA that does not have a phosphorus atom in its internucleoside backbone may be referred to as an oligonucleoside. In certain embodiments of the invention, a modified RNA has a phosphorus atom in its internucleoside backbone.

It should be understood that the terms "RNA molecule" or "RNA" or "ribonucleic acid molecule" encompass not only RNA molecules as expressed or found in nature, but also analogues and derivatives of RNA, comprising one or more ribonucleotide/ribonucleoside analogues or derivatives herein as described or known in the art. The terms "ribonucleoside" and "ribonucleotide" may be used interchangeably herein. RNA molecules may be modified in the nucleobase structure or ribose-phosphate backbone structure (e.g., as described hereinbelow), and molecules containing ribonucleoside analogs or derivatives must retain the ability to form duplexes. As non-limiting examples, an RNA molecule may also comprise at least one modified ribonucleoside, including, but not limited to, 2'-O-methyl modified nucleosides, nucleosides containing a 5' phosphorothioate group, terminal nucleosides linked to a cholesterol derivative or dodecanoic acid bisdecylamide group, locked nucleosides, abasic nucleosides, 2'-deoxy-2'-fluoro modified nucleosides, 2'-amino modified nucleosides, 2'-alkyl modified nucleosides, morpholino nucleosides, phosphoramidates, or unnatural bases containing nucleosides, or any combination thereof. In some embodiments of the invention, an RNA molecule comprises the following number of modified ribonucleosides: at least 1, 2, 3, 4, 5, 6, 7, 8, 9, 10, 11, 12, 13, 14, 15, 16, 17, 18, 19, 20 or up to the full length of the ribonucleosides of the AGT dsRNA agent molecule. The modifications need not be the same for each of the plurality of modified ribonucleosides in such an RNA molecule.

In some embodiments, dsRNA agents, AGT antisense polynucleotides, and/or AGT sense polynucleotides of the invention may comprise one or more independently selected modified nucleotides and/or one or more independently selected non-phosphodiester bonds. As used herein, the term "independently selected" when used to refer to selected elements, such as modified nucleotides, non-phosphodiester bonds, etc., means that two or more selected elements may be, but need to be, identical to each other. As used herein, a "nucleotide base", "nucleotide" or "nucleobase" is a heterocyclic pyrimidine or purine compound that is a standard constituent of all nucleic acids and includes the bases that form nucleotides: adenine (a), guanine (g), cytosine (c), thymine (t) and uracil (u). Nucleobases may be further modified to include, though not intended to be limited to, universal bases, hydrophobic bases, promiscuous bases, size-expanded bases, and fluorinated bases. The term "ribonucleotide" or "nucleotide" may be used herein to refer to unmodified nucleotides, modified nucleotides, or alternative moieties. One skilled in the art will recognize that guanine, cytosine, adenine and uracil can be replaced by other moieties without significantly altering the base pairing properties of an oligonucleotide comprising a nucleotide bearing such a replacement moiety.

In one embodiment, modified RNAs contemplated for use in the methods and compositions described herein are peptide nucleic acids (PNAs) with the ability to form the desired duplex structure and allow or mediate the specific degradation of a target RNA via a RISC pathway. In certain embodiments of the invention, AGT RNA interfering agents comprise single-stranded RNAs that interact with a target AGT RNA sequence to direct the cleavage of the target AGT RNA.

Modified RNA backbones may include, for example, phosphorothioates, chiral phosphorothioates, phosphorodithioates, phosphotriesters, aminoalkylphosphotriesters, methyl and other alkyl phosphonates (including 3'-alkylene phosphonates and chiral phosphonates), phosphinates, phosphoramidates (including 3'-aminophosphoramidate and aminoalkyl phosphoramidates), thiophosphoramidates, thioalkylphosphonates, thioalkylphosphotriesters, and boranophosphates (having normal 3'-5' linkages, as well as 2'-5' linkage analogues of these, and those with inverted polarity, in which adjacent pairs of nucleoside units are linked in a 3'-5' to 5'-3' or 2'-5' to 5'-2' format). Also included are various salts, mixed salts and free acid forms. Methods for preparing phosphorus-containing bonds are routinely practiced in the art, and such methods can be used to prepare certain modified AGT dsRNA agents, certain modified AGT antisense polynucleotides, and/or certain modified AGT sense polynucleotides of the invention.

Modified RNA backbones that do not contain a phosphorus atom therein have structures formed of short-chain alkyl or cycloalkyl internucleoside linkages, mixed heteroatoms and alkyl or cycloalkyl internucleoside linkages, or one or more short chains heteroatomic or heterocyclic internucleoside linkages. They include those with morpholino bonds (formed in part from the sugar portion of a nucleoside); siloxane backbones; sulfide, sulfoxide and sulfone backbones; methylacetyl and thiomethylacetyl backbones; methylene methacetyl and thiomethylacetyl backbones; alkene containing backbones; sulfamate backbones; methyleneimino and methylenehydrazino backbones; sulfonate and sulfonamide backbones; amide backbones; and other parts with mixed N, O, S and $CH_2$ components. Methods of preparing modified RNA backbones that do not contain phosphorus atoms are routinely practiced in the art, and such methods can be used to prepare certain modified AGT dsRNA agents, certain modified AGT antisense polynucleotides, and/or certain modified AGT sense polynucleotides of the present invention.

In certain embodiments of the invention, RNA mimetics are included in AGT dsRNAs, AGT antisense polynucleotides, and/or AGT sense polynucleotides, such as, but not limited to, using novel groups in place of the sugar and internucleoside linkage (i.e. the backbone) of the nucleotide units. In such embodiments, base units are maintained for hybridization with the appropriate AGT nucleic acid target compound. One such oligomeric compound, an RNA mimetic that has been shown to have excellent hybridization properties, is referred to as a peptide nucleic acid (PNA). In PNA compounds, the sugar backbone of an RNA is replaced by an amide-containing backbone, specifically an aminoethylglycine backbone. The nucleobases are retained and bound directly or indirectly to the aza nitrogen atoms of the amide portion of the backbone. Methods of preparing RNA mimetics are routinely practiced in the art, and such methods can be used to prepare certain modified AGT dsRNA agents of the invention.

Some embodiments of the invention include RNAs with phosphorothioate backbones and oligonucleosides with heteroatom backbones, and in particular —$CH_2$—NH—$CH_2$—, —$CH_2$—N($CH_3$)—O—$CH_2$-[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$~[wherein the native phosphodiester backbone is represented as —O—P—O—$CH_2$—]. Methods for preparing RNAs with phosphorothioate backbones and oligonucleotides with heteroatom backbones are routinely practiced in the art, and such methods can be used to prepare certain modified AGT dsRNA agents, certain AGT antisense polynucleotides and/or certain AGT sense polynucleotides of the invention.

Modified RNA may also contain one or more substituted sugar moieties. AGT dsRNAs, AGT antisense polynucleotides and/or AGT sense polynucleotides of the present invention may comprise one of the following at the 2' position: OH; F; O-, S-, or N-alkyl; O-, S- or N-alkenyl; O-, S- or N-alkynyl; or O-alkyl-O-alkyl, where alkyl, alkenyl and alkynyl may be substituted or unsubstituted $C_1$ to $C_{10}$ alkyl or $C_2$ to $C_{10}$ alkenyl and alkynyl. Exemplary suitable modifications include: O[($CH_2$)$_n$O]$_m$$CH_3$, O($CH_2$)$_n$O$CH_3$, O($CH_2$)$NH_2$, O($CH_2$); $CH_3$, O($CH_2$)$_n$O$NH_2$, and O($CH_2$)$_n$ ON[($CH_2$)$_n$$CH_3$)]$_2$, where n and m are from 1 to about 10. In other embodiments, the dsRNA includes one of the following at the 2' position: $C_1$ to $C_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group used to improve the pharmacokinetic properties of an AGT dsRNA agent, or a group used to improve the pharmacodynamic properties of an AGT dsRNA agent, AGT antisense polynucleotide and/or AGT sense polynucleotide, and other substituents with similar properties. In some embodiments, modifications include 2'-methoxyethoxy (2'-O—CH$_2$CH$_2$OCH$_3$, also known as 2'-O-(2-methoxyethyl) or 2'-MOE) (Martin et al., *Helv. Chim. Acta,* 1995, 78:486-504), i.e. an alkoxy-alkoxy group. Another exemplary modification is 2'-dimethylaminoethoxyethoxy, i.e., a O(CH$_2$)$_2$ON(CH$_3$) 2 group, also known as 2'-DMAOE, as described in examples hereinbelow, and 2'-dimethylamino-ethoxyethoxy (also known in the art as 2'-O-dimethylaminoethoxyethyl or 2'-DMAEOE), i.e. 2'-O—CH$_2$—O—CH$_2$—N(CH$_2$)$_2$. Methods of preparing modified RNAs such as those described are routinely practiced in the art, and such methods can be used to prepare certain modified AGT dsRNA agents of the invention.

Other modifications include 2'-methoxy (2'-OCH$_3$), 2'-aminopropoxy (2'-OCH$_2$CH$_2$CH$_2$NH$_2$) and 2'-fluoro (2'-F). Similar modifications can also be made at other positions on the RNA of an AGT dsRNA agent, AGT antisense polynucleotide, AGT sense polynucleotide and/or AGT sense polynucleotide of the invention, especially the 3' position of the sugar on the 3' terminal nucleotide or in 2'-5' linked AGT dsRNAs, AGT antisense polynucleotides, or AGT sense polynucleotides, and the 5' position of the 5' terminal nucleotide, AGT dsRNA agents, AGT antisense polynucleotides, and/or AGT sense polynucleotides may also have sugar mimetics, such as a cyclobutyl moiety in place of the pentofuranosyl sugar. Methods of preparing modified RNAs such as those described are routinely practiced in the art, and such methods can be used to prepare certain modified AGT dsRNA agents, AGT antisense polynucleotides, and/or AGT sense polynucleotides of the invention.

In some embodiments, AGT dsRNA agents, AGT antisense polynucleotides, and/or AGT sense polynucleotides may include nucleobase (commonly referred to as "bases" in the art) modifications or substitutions. As used herein, "unmodified" or "natural" nucleobases include the purine bases adenine (A) and guanine (G), and the pyrimidine bases thymine (T), cytosine (C), and uracil (U). Modified nucleobases include other synthetic and natural nucleobases, such as 5-methylcytosine (5-me-C), 5-hydroxymethylcytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosan pyrimidine, 5-halouracil and cytosine, 5-propynyluracil and cytosine, 6-azouracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo, particularly 5-bromo, 5-trifluoromethyl and other 5-substituted uracils and cytosines; 7-methylguanine and 7-methyladenine, 8-azaguanine and 8-azaadenine, 7-azaguanine and 7-azaadenine, as well as 3-azaguanine and 3-azaadenine. Additional nucleobases that may be included in certain embodiments of the AGT dsRNA agents of the invention are known in the art, see, for example: Modified Nucleosides in Biochemistry, Biotechnology and Medicine, Herdewijn, P. Ed. Wiley-VCH, 2008; The Concise Encyclopedia Of Polymer Science And Engineering, pages 858-859, Kroschwitz, J. L, Ed. John Wiley & Sons, 1990, English et al., Angewandte Chemie, International Edition, 1991, 30, 613, Sanghvi, Y S., Chapter 15, dsRNA Research and Applications, pages 289-302, and Crooke, S T and Lebleu, B., Ed., CRC Press, 1993. Methods of preparing dsRNA, AGT antisense strand polynucleotides, and/or AGT sense strand polynucleotides comprising nucleobase modifications and/or substitutions such as those described herein are routinely practiced in the art, and such methods can be used to prepare certain modified AGT dsRNA agents, AGT sense polynucleotides and/or AGT antisense polynucleotides of the present invention.

Certain embodiments of the AGT dsRNA agents, AGT antisense polynucleotides, and/or AGT sense polynucleotides of the invention include RNA modified to include one or more locked nucleic acids (LNAs). Locked nucleic acids are nucleotides with a modified ribose moiety comprising an additional bridge connecting the 2' and 4' carbons. This structure effectively "locks" ribose in the 3'-endo structural conformation. Adding a locked nucleic acid to an AGT dsRNA agent, AGT antisense polynucleotide and/or AGT sense polynucleotide of the present invention may increase stability in serum and reduce off-target effects (Elmen, J. et al., (2005) *Nucleic Acids Research* 33 (1): 439-447; Mook, O R. et al., (2007) Mol Canc Ther 6 (3): 833-843; Grunweller, A. et al., (2003) *Nucleic Acids Research* 31 (12): 3185-3193). Methods of preparing dsRNA agents, AGT antisense polynucleotides, and/or AGT sense polynucleotides that comprise locked nucleic acids are routinely practiced in the art, and such methods can be used to prepare certain modified AGT dsRNA agents of the invention. Certain embodiments of AGT dsRNA compounds, sense polynucleotides and/or antisense polynucleotides of the invention include at least one modified nucleotide, wherein the at least one modified nucleotide comprises: 2'-O-methyl nucleotides, 2'-fluoro nucleotides, 2'-deoxy nucleotides, 2',3'-seco nucleotide mimics, locked nucleotides, 2'-F-arabino nucleotides, 2'-methoxyethyl nucleotides, 2'-amino modified nucleotides, 2'-alkyl modified nucleotides, morpholino nucleotides and 3'-Ome nucleotides, nucleotides containing a 5'-phosphorothioate group, or terminal nucleotides linked to a cholesterol derivative or dodecanoic acid bisdecylamide group, 2'-amino modified nucleotides, phosphoramidates, or unnatural bases containing nucleotides. In some embodiments, an AGT dsRNA compound contains an E-vinylphosphonate nucleotide at the 5' end of the antisense strand (also referred to herein as the guide strand).

In certain embodiments of the invention, at least one modified nucleotide is included at a AGT dsRNA compound, 3' and 5' end of a sense polynucleotide, and/or the 3' end of an antisense polynucleotide, wherein the at least one modified nucleotide comprises abasic nucleotides, ribitol, inverted nucleotides, inverted abasic nucleotides, inverted 2'-OMe nucleotides, and inverted 2'-deoxynucleotides. It is known to those skilled in the art that the inclusion of abasic or inverted abasic nucleotides at the end of an oligonucleotide can enhance stability (Czauderna et al. Structural variations and stabilizing modifications of synthetic siRNAs in mammalian cells. *Nucleic Acids Res.* 2003; 31 (11): 2705-2716. doi: 10.1093/nar/gkg393).

In certain embodiments of the invention, AGT dsRNA compounds and antisense polynucleotides comprise at least one modified nucleotide, wherein said at least one modified nucleotide comprises unlocked nucleic acid (UNA) nucleotides and/or glycol nucleic acid (GNA) nucleotides. It is known to those skilled in the art that UNAs and GNAs are thermally unstable chemical modifications that can significantly improve the off-target profile of a siRNA compound (Janas, et al., Selection of GalNAc-conjugated siRNAs with limited off-target-driven rat hepatotoxicity. *Nat Commun* 2018; 9 (1): 723. doi: 10.1038/s41467-018-02989-4; Laursen et al., Utilization of unlocked nucleic acid (UNA) to enhance siRNA performance in vitro and in vivo. *Mol BioSyst.* 2010; 6:862-70).

Another modification that may be included in the RNA of certain embodiments of AGT dsRNA agents, AGT antisense polynucleotides, and/or AGT sense polynucleotides of the invention comprises one or more ligands, moieties or conjugates chemically linked to RNA that enhance one or more characteristics of the AGT dsRNA agent, AGT antisense polynucleotide and/or AGT sense polynucleotide, respectively. Non-limiting examples of characteristics that can be enhanced are: AGT dsRNA agent, AGT antisense polynucleotide and/or AGT sense polynucleotide activity, cellular distribution, delivery of an AGT dsRNA agent, pharmacokinetic properties of the AGT dsRNA agent, and cellular uptake of the AGT dsRNA agent. In some embodiments of the invention, the AGT dsRNA agents comprise one or more targeting or linking groups, which, in certain embodiments of the invention, are conjugated to the sense strand. A non-limiting example of a targeting groups is a compounds comprising N-acetyl-galactosamine (GalNAc). The terms "targeting agent", "linking agent", "targeting compound", and "targeting ligand" may be used interchangeably herein. In certain embodiments of the invention, AGT dsRNA agents comprise a targeting compound conjugated to the 5'-end of the sense strand. In certain embodiments of the invention, AGT dsRNA agents comprise a targeting compound conjugated to the 3'-end of the sense strand. In some embodiments of the invention, the AGT dsRNA agent comprises a GalNAc-containing targeting group. In certain embodiments of the invention, the AGT dsRNA agent does not include a targeting compound conjugated to one or both of the 3'-end and 5'-end of the sense strand. In certain embodiments of the invention, the AGT dsRNA agent does not include a GalNAc-containing targeting compound conjugated to one or both of the 5'-end and the 3'-end of the sense strand.

Additional targeting and linking agents are well known in the art, for example, targeting and linking agents useful in certain embodiments of the present invention include, but are not limited to, lipid moieties such as cholesterol moieties (Letsinger et al., *Proc. Natl. Acid. Sci. USA,* 1989, 86:6553-6556), cholic acid (Manoharan et al., *Biorg. Med. Chem. Let.,* 1994, 4:1053-1060), thioethers, such as beryl-S-tritylthiol (Manoharan et al., *Ann. NY Acad. Sci.,* 1992, 660:306-309; Manoharan et al., *Biorg. Med. Chem. Let.,* 1993, 3:2765-2770), thiocholesterols (Oberhauser et al., *Nucl. Acids Res.,* 1992, 20:533-538), aliphatic chains such as dodecanediol or undecyl residues (Saison-Behmoaras et al., *EMBO J,* 1991, 10:1111-1118; Kabanov et al., *FEBS Lett.,* 1990, 259:327-330; Svinarchuk et al., *Biochimie,* 1993, 75:49-54), phospholipids, such as 2-hexadecyl-rac-glycerol or triethylammonium 1,2-di-O-hexadecyl-rac-glycerol-3-phosphonate (Manoharan et al., *Tetrahedron Lett.,* 1995, 36:3651-3654; Shea et al., *Nucl. Acids Res.,* 1990, 18:3777-3783), polyamine or polyethylene glycol chains (Manoharan et al., *Nucleosides & Nucleotides,* 1995, 14:969-973) or adamantane acetic acid (Manoharan et al., *Tetrahedron Lett.,* 1995, 36:3651-3654), palmitoyl moieties (Mishra et al., *Biochim. Biophys. Acta,* 1995, 1264:229-237) or octadecylamine or hexylamino-carbonyloxycholesterol moieties (Crooke et al., *J. Pharmacol. Exp. Ther.,* 1996, 277:923-937).

Certain embodiments of compositions comprising AGT dsRNA agents, AGT antisense polynucleotides, and/or AGT sense polynucleotides may include ligands that alter the distribution, targeting, etc. properties of the AGT dsRNA agent. In some embodiments of compositions comprising an AGT dsRNA agent of the invention, e.g., the ligand increases affinity for a selected target (e.g., molecule, cell or cell type, compartment, e.g., a cell or organ compartment, tissue, organ or body region) compared to a species in which such ligand is not present). Ligands useful in the compositions and/or methods of the invention may be naturally occurring substances such as proteins (e.g., human serum albumin (HSA), low density lipoprotein (LDL) or globulin), carbohydrates (e.g., dextran, amylopectin, chitin, chitosan, inulin, cyclodextrin or hyaluronic acid) or lipids. Ligands may also be recombinant or synthetic molecules, such as synthetic polymers, such as synthetic polyamino acids or polyamines. Examples of polyamino acids are polylysine (PLL), poly L-aspartic acid, poly L-glutamic acid, styrene-maleic anhydride copolymer, poly(L-lactide-co-glycolic acid) copolymer, divinyl ether-maleic anhydride copolymer, N-(2-hydroxypropyl) methacrylamide copolymer (HMPA), polyethylene glycol (PEG), polyvinyl alcohol (PVA), polyurethane, poly(2-ethylacrylic acid), N-isopropylacrylamide polymer, or polyphosphazine. Examples of polyamines include: polyethylenimine, polylysine (PLL), spermine, spermidine, polyamines, pseudopeptide-polyamines, peptidomimetic polyamines, dendritic polyamines, arginine, amidine, protamine, cationic lipids, cationic porphyrins, quaternary salts of polyamines, or α-helical peptides.

Ligands included in the compositions and/or methods of the invention may comprise targeting groups, non-limiting examples of which are cell or tissue targeting agents, for example, lectins, glycoproteins, lipids or proteins, e.g. an antibody binding to specific cell types such as kidney cells or liver cells. Targeting groups can be thyrotropin, melanogen, lectin, glycoprotein, surfactant protein A, mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, lipids, cholesterol, steroids, bile acids, folic acid, vitamin B12, vitamin A, biotin or RGD peptides or RGD peptide mimetics.

Other examples of ligands include dyes, intercalators (e.g., acridines), cross-linkers (e.g., psoralen, mitomycin C), porphyrins (TPPC4, texaphyrin, sapphyrin), polycyclic aromatic hydrocarbons (e.g., phenazine, dihy drophenazine), artificial endonucleases (e.g. EDTA), lipophilic molecules e.g. cholesterol, cholic acid, adamantane acetic acid, 1-pyrenebutyric acid, dihydrotestosterone, 1,3-bis-O(hexadecyl)glycerin, geranyloxyhexyl, hexadecylglycerol, borneol, menthol, 1,3-propanediol, heptadecyl, palmitic acid, myristic acid, O3-(oleoyl) lithocholic acid, O3-(oleoyl) cholic acid, dimethoxytrityl or phenoxazine and peptide conjugates (e.g., antennapedia peptide, Tat peptide), alkylating agents, phosphates, amino, mercapto, PEG (e.g. PEG-40K), MPEG, [MPEG]$_2$, polyamino, alkyl, substituted alkyl, radiolabeled markers, enzymes, baptens (e.g., biotin), transport/absorption enhancers (e.g., aspirin, vitamin E, folic acid), synthetic ribonucleases (e.g. imidazole, bisimidazole, histamine, imidazole clusters, acridine-imidazole conjugates, Eu$^{3+}$ complexes of tetraazamacrocycles), dinitrophenyl, HRP or AP.

Ligands included in the compositions and/or methods of the present invention may be proteins, such as glycoproteins or peptides, for example a molecule with specific affinity for a co-ligand, or antibodies, for example an antibody that binds to specific cell types such as cancer cells, endothelial cells, cardiomyocytes or bone cells. Ligands useful in embodiments of the compositions and/or methods of the invention may be hormones or hormone receptors. Ligands useful in embodiments of the compositions and/or methods of the invention may be lipids, lectins, carbohydrates, vitamins, coenzymes, multivalent lactose, multivalent galactose, N-acetyl-galactosamine, N-acetyl-glucosamine multivalent mannose or multivalent fucose. Ligands useful in embodiments of the compositions and/or methods of the invention may be substances that increase update of the AGT dsRNA agent into the cell, for example, by disrupting the cell's cytoskeleton (e.g., by disrupting the cell's microtubules, microfilaments, and/or intermediate filaments). Non-limiting examples of such agents are: taxon, vincristine, vinblastine, cytochalasin, nocodazole, jasplakinolide, latrunculin A, phalloidin, swinholide A, indanocine and myoservin.

In some embodiments, ligands linked to the AGT dsRNA agents of the invention serve as pharmacokinetic (PK) modulators. Examples of PK modulators useful in the compositions and methods of the present invention include, but are not limited to: lipophilic agents, bile acids, steroids, phospholipid analogues, peptides, protein binders, PEG, vitamins, cholesterol, fatty acids, cholic acid, lithocholic acid, dialkylglycerides, diacylglycerides, phospholipids, sphingolipids, naproxen, ibuprofen, vitamin E, biotin, and aptamers that bind to serum proteins, etc. Oligonucleotides containing many phosphorothioate linkages are also known to bind to serum proteins, therefore short oligonucleotides containing multiple phosphorothioate linkages in the backbone, e.g., oligonucleotides of about 5 bases, 10 bases, 15 bases or 20 bases, may also be used as ligands in the compositions and/or methods of the invention.

AGT dsRNA Agent Compositions

In some embodiments of the invention, an AGT dsRNA agent is in a composition. The compositions of the present invention may comprise one or more AGT dsRNA agents and optionally one or more pharmaceutically acceptable carriers, delivery agents, targeting agents, detectable labels, etc. Non-limiting examples of targeting agents that may be useful according to some embodiments of methods of the invention are agents that direct an AGT dsRNA agent of the invention to and/or into a cell to be treated. The choice of targeting agent will depend on the nature of the AGT-associated disease or condition, and the target cell type. In a non-limiting example, in some embodiments of the invention it may be desirable to target an AGT dsRNA agent to and/or into hepatocytes. It should be understood that in some embodiments of the methods of the invention, a therapeutic agent comprises an AGT dsRNA agent with only a delivery agent, such as a delivery agent comprising N-acetylgalactosamine (GalNAc), without any additional linking elements. For example, in some aspects of the invention, an AGT dsRNA agent can be linked to a delivery compound comprising GalNAc and included in a composition containing a pharmaceutically acceptable carrier, and administered to a cell or subject in the absence of any detectable label or targeting agents, etc. linked to the AGT dsRNA agent.

Where the AGT dsRNA agents of the present invention are administered together with and/or linked to one or more delivery agents, targeting agents, labeling agents, etc., one skilled in the art would understand and be able to select and use appropriate agents for use in the methods of the invention. Labeling agents may be used in certain methods of the invention to determine the location of an AGT dsRNA agent in cells and tissues, and may be used to identify a cell, tissue, or organ location of a therapeutic composition comprising an AGT dsRNA agent administered in the methods of the invention. Means for attaching and using labeling reagents such as enzyme labels, dyes, radiolabels, etc. are well known in the art. It should be understood that in some embodiments of the compositions and methods of the invention, a labeling agent is linked to one or both of a sense and an antisense polynucleotide included in an AGT dsRNA agent.

Delivery of AGT dsRNA Agents and AGT Antisense Polynucleotide Agents

Certain embodiments of the methods of the invention include delivery of an AGT dsRNA agent into a cell. As used herein, the term "delivery" means promoting or influencing cellular uptake or absorption. Absorption or uptake of AGT dsRNA agents can occur by independent diffusion or active cellular processes, or through the use of delivery agents, targeting agents, etc., that may be associated with an AGT dsRNA agent of the invention. Modes of delivery suitable for use in the methods of the present invention include, but are not limited to, in vivo delivery, in which the AGT dsRNA agent is injected into a tissue site or administered systemically. In some embodiments of the invention, the AGT dsRNA agent is linked to a delivery agent.

Non-limiting examples of methods that can be used to deliver AGT dsRNA agents to cells, tissues, and/or subjects include: AGT dsRNA-GalNAc conjugates, SAMiRNA technology, LNP-based delivery methods, and naked RNA delivery. These and other delivery methods have been used successfully in the art to deliver therapeutic RNAi agents to treat a variety of diseases and conditions, such as, but not limited to: liver diseases, acute intermittent porphyria (AIP), hemophilia, pulmonary fibrosis, etc. Details of various delivery methods can be found in publications such as: Nikam, R. R. & K. R. Gore (2018) *Nucleic Acid Ther*, 28 (4), 209-224 August 2018; Springer A. D. & S. F. Dowdy (2018) *Nucleic Acid Ther*. June 1; 28 (3): 109-118; Lee, K. et al., (2018) *Arch Pharm Res,* 41 (9), 867-874; and Nair, J. K. et al., (2014) *J. Am. Chem. Soc.* 136:16958-16961, the contents of which are incorporated herein by reference.

Some embodiments of the invention include the use of lipid nanoparticles (LNPs) to deliver an AGT dsRNA agent of the invention to a cell, tissue and/or subject. LNPs are commonly used for in vivo delivery of AGT dsRNA agents, including therapeutic AGT dsRNA agents. One benefit of using an LNP or other delivery agent is that the stability of the AGT RNA agent is increased when delivered to a subject using LNP or other delivery agent. In some embodiments of the invention, the LNP comprises a cationic LNP loaded with one or more AGT RNAi molecules of the invention. The LNP comprising the AGT RNAi molecule(s) is administered to a subject, the LNP and its attached AGT RNAi molecules are taken up by cells via endocytosis, and their presence results in the release of RNAi trigger molecules, thereby mediating RNAi.

Another non-limiting example of a delivery agent that may be used in embodiments of the invention to deliver an AGT dsRNA agent of the invention to a cell, tissue and/or subject is an agent comprising GalNAc that is linked to the AGT dsRNA agent of the invention and delivers the AGT dsRNA agent to a cell, tissue, and/or subject. Examples of certain other GalNAc-containing delivery agents that may be used in certain embodiments of the methods and compositions of the present invention are disclosed in PCT application WO2020191183A1. A non-limiting example of a GalNAc targeting ligand that can be used in the compositions and methods of the invention to deliver an AGT dsRNA agent to a cell is a targeting ligand cluster. Examples of targeting ligand clusters proposed here are: GalNAc ligands with phosphodiester linkages (GLO) and GalNAc ligands with phosphorothioate linkages (GLS). The term "GLX-n" may be used herein to mean that the attached GalNAC-containing compound is the any one of compounds GLS-1, GLS-2, GLS-3, GLS-4, GLS-5, GLS-6, GLS-7, GLS-8, GLS-9, GLS-10, GLS-11, GLS-12, GLS-13, GLS-14, GLS-15, GLS-16, GLO-1, GLO-2, GLO-3, GLO-4, GLO-5, GLO-6, GLO-7, GLO-8, GLO-9, GLO-10, GLO-11, GLO-12, GLO-13, GLO-14, GLO-15 and GLO-16, the structure of each is as shown below. In the figures below, the connection position of the GalNAc targeting ligand and the RNAi agent of the present invention is on the rightmost side of each targeting ligand. It should be understood that any RNAi and dsRNA molecule of the invention can be linked to the GLS-1, GLS-2, GLS-3, GLS-4, GLS-5, GLS-6, GLS-7, GLS-8, GLS-9, GLS-10, GLS-11, GLS-12, GLS-13, GLS-14, GLS-15, GLS-16, GLO-1, GLO-2, GLO-3, GLO-4, GLO-5, GLO-6, GLO-7, GLO-8, GLO-9, GLO-10, GLO-11, GLO-12, GLO-13, GLO-14, GLO-15 and GLO-16. Below are the structures of GLO-1 to GLO-16 and GLS-1 to GLS-16.

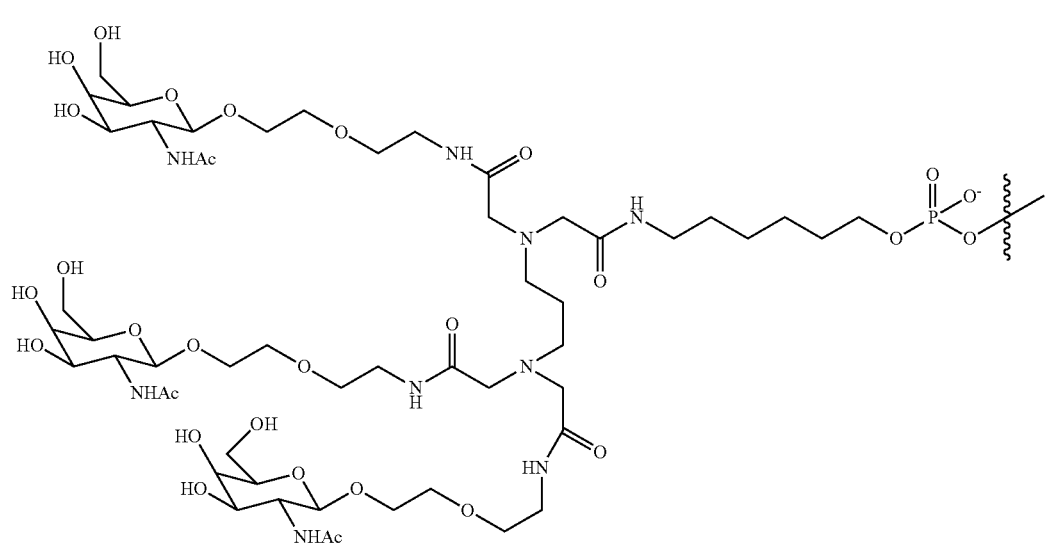

GLO-1

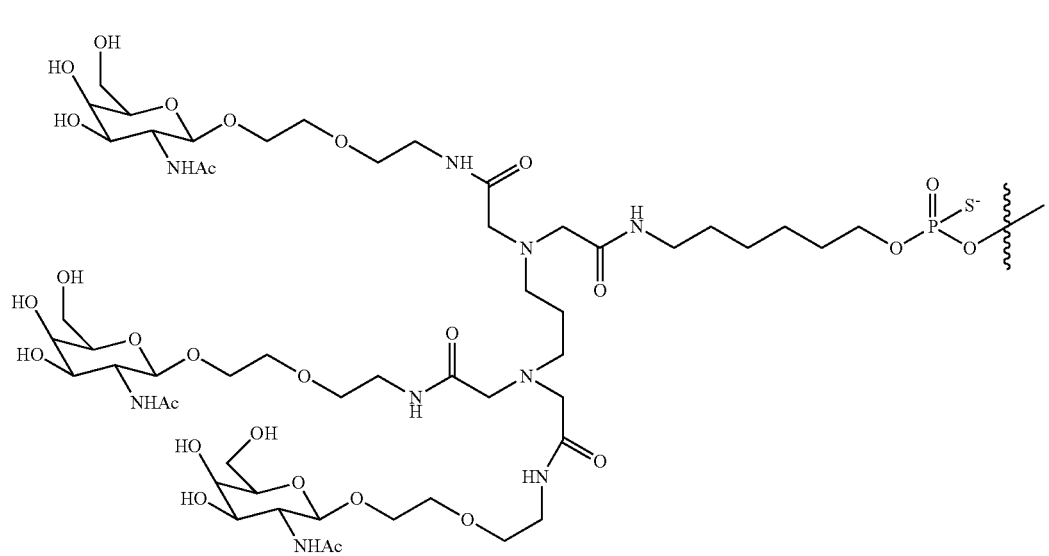

GLS-1

-continued
GLO-2
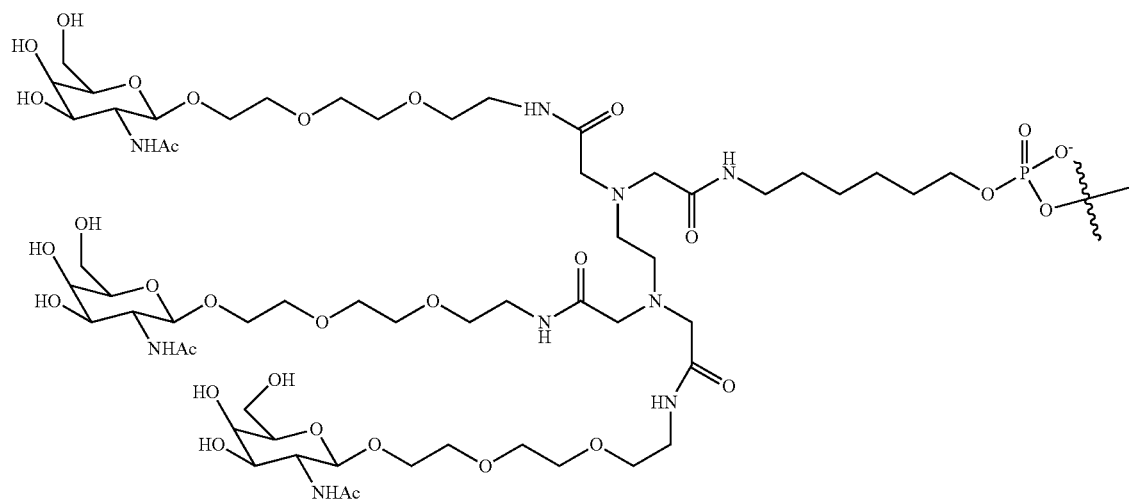
GLS-2
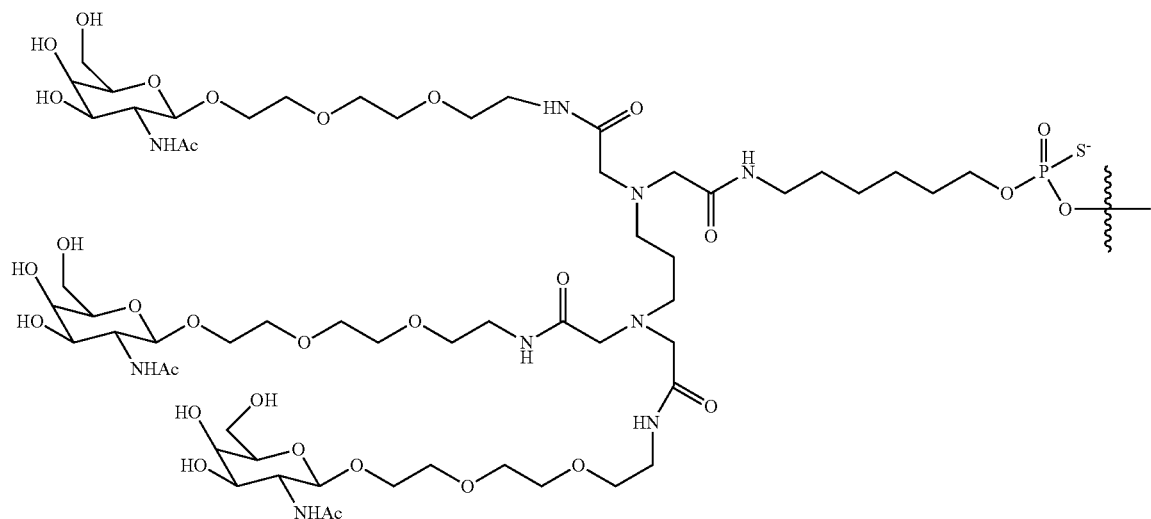
GLO-3
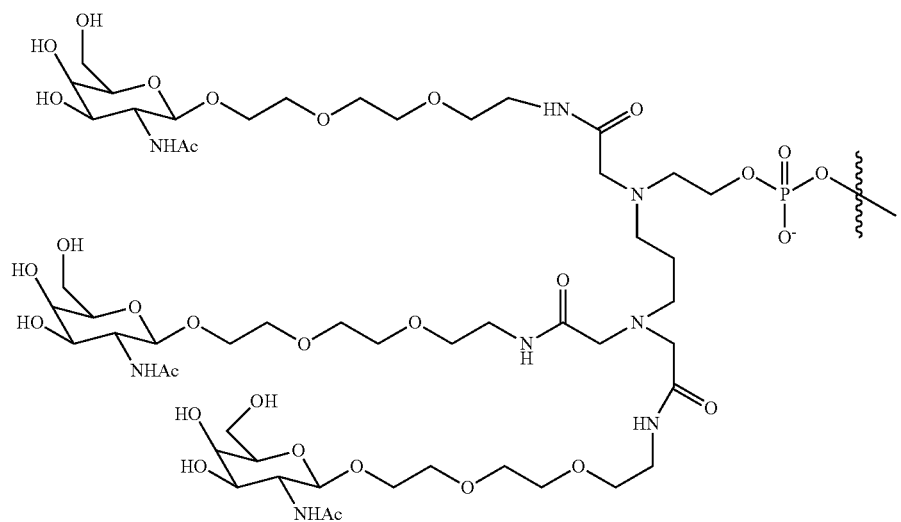

-continued
GLS-3
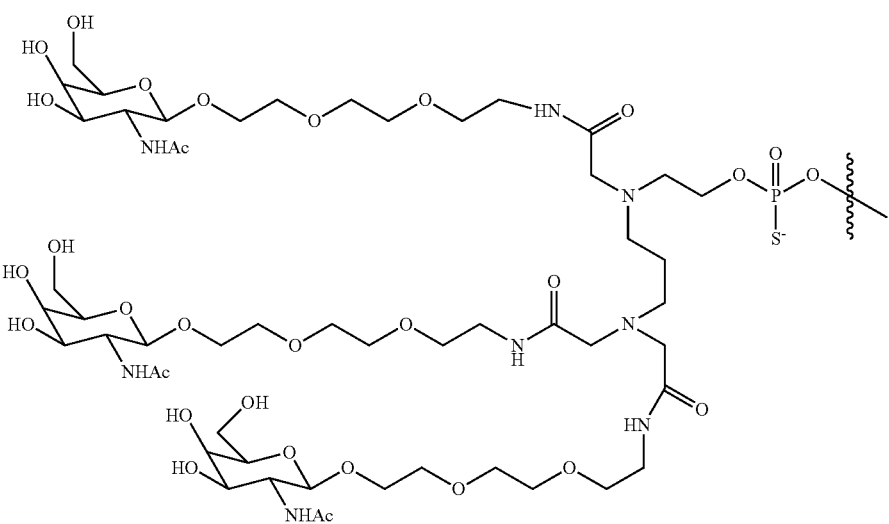
GLO-4
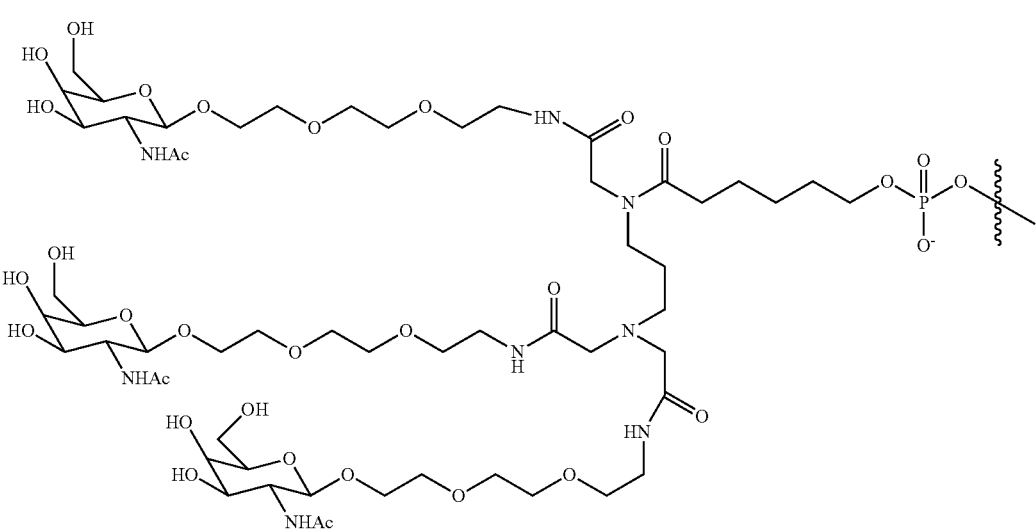
GLS-4
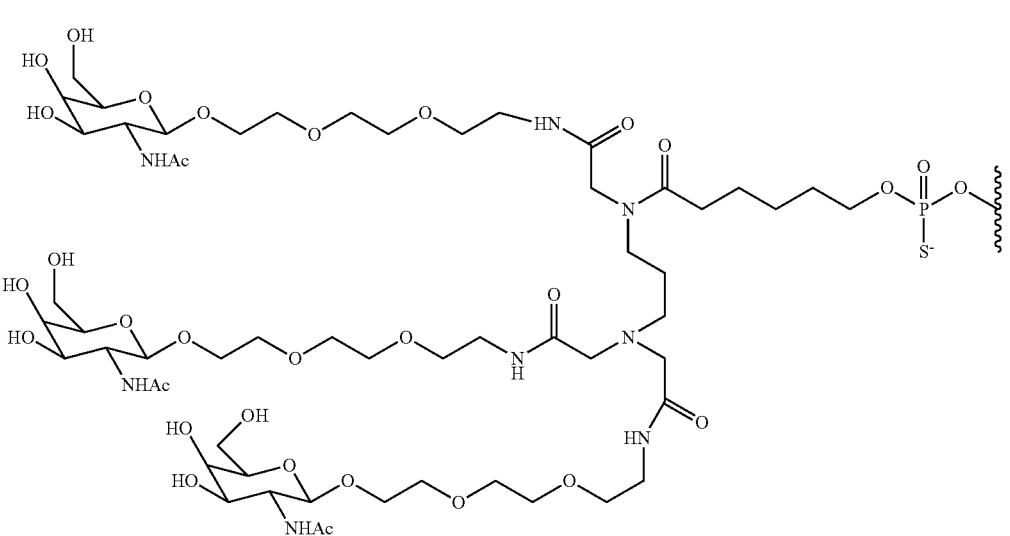

GLO-5
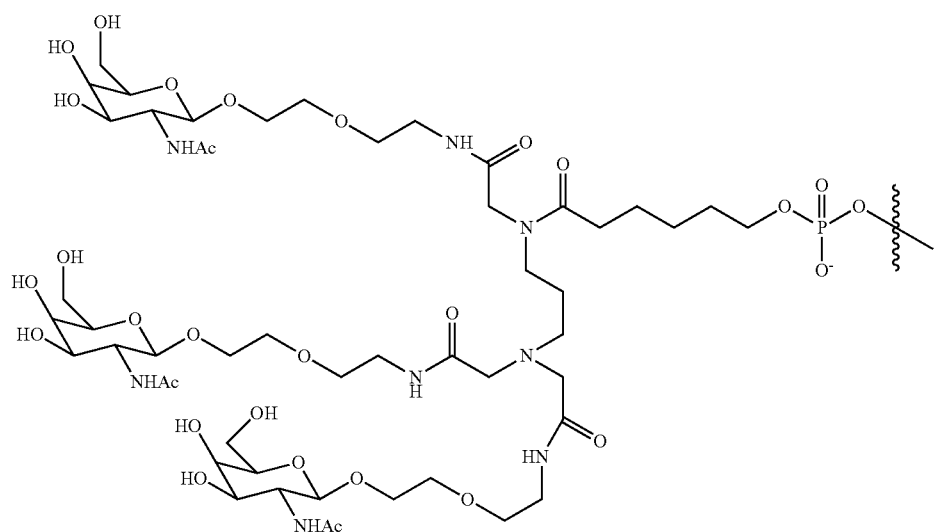
GLS-5
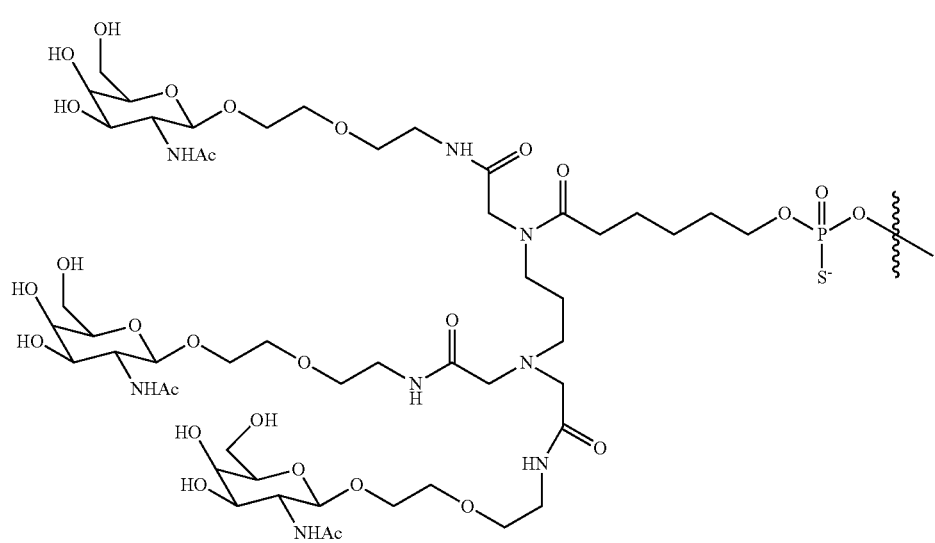
GLO-6
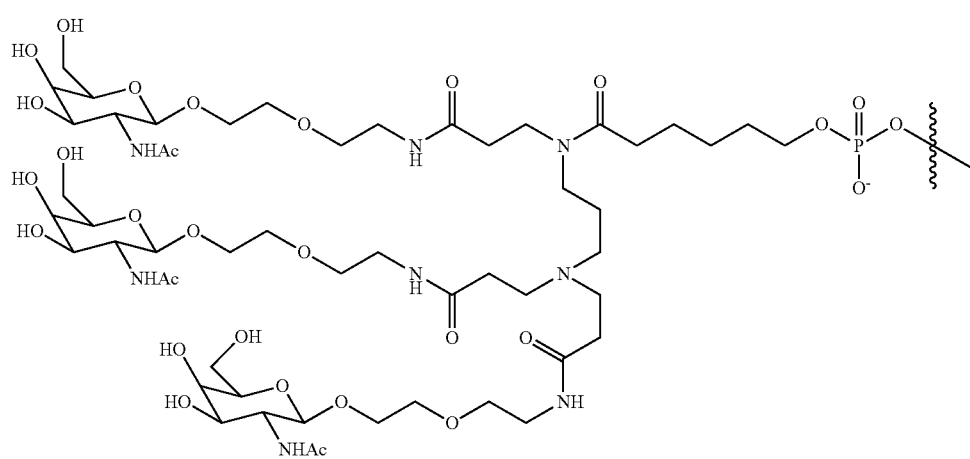

-continued
GLS-6
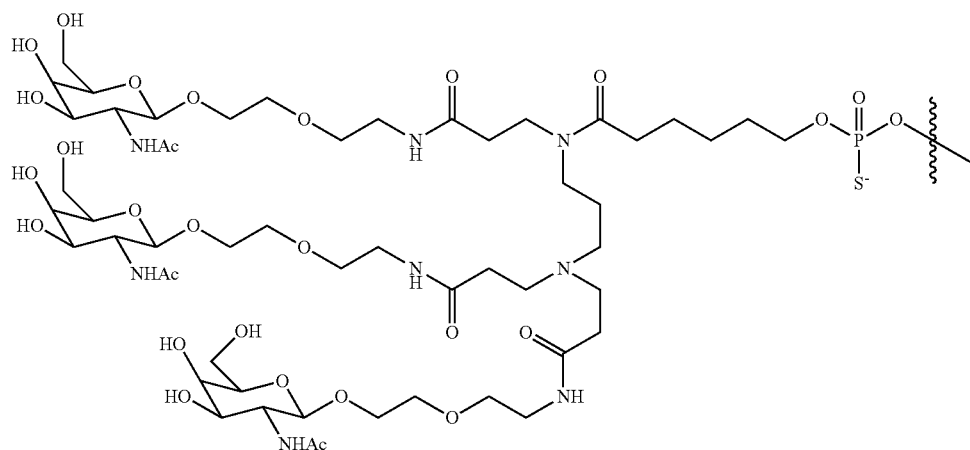
GLO-7
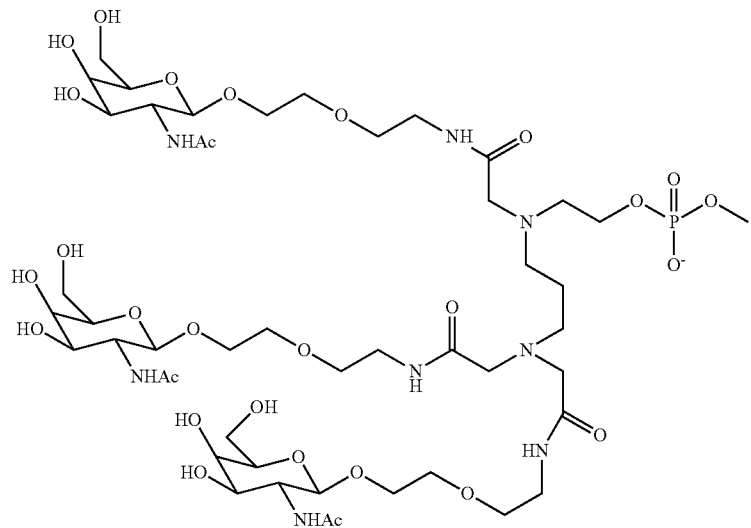
GLS-7
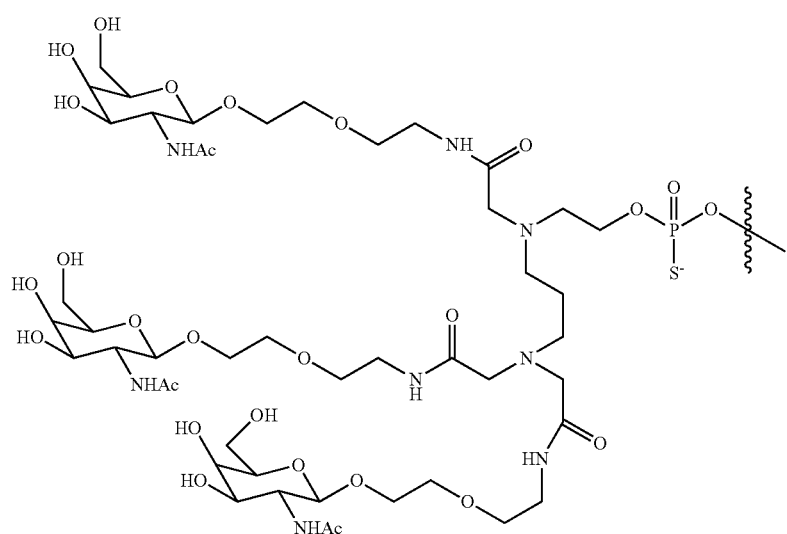

GLO-8
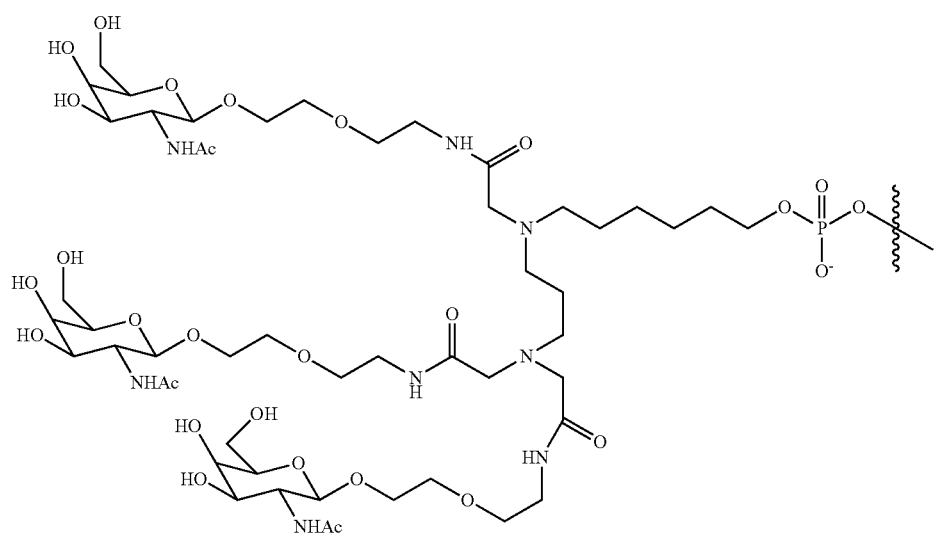
GLS-8
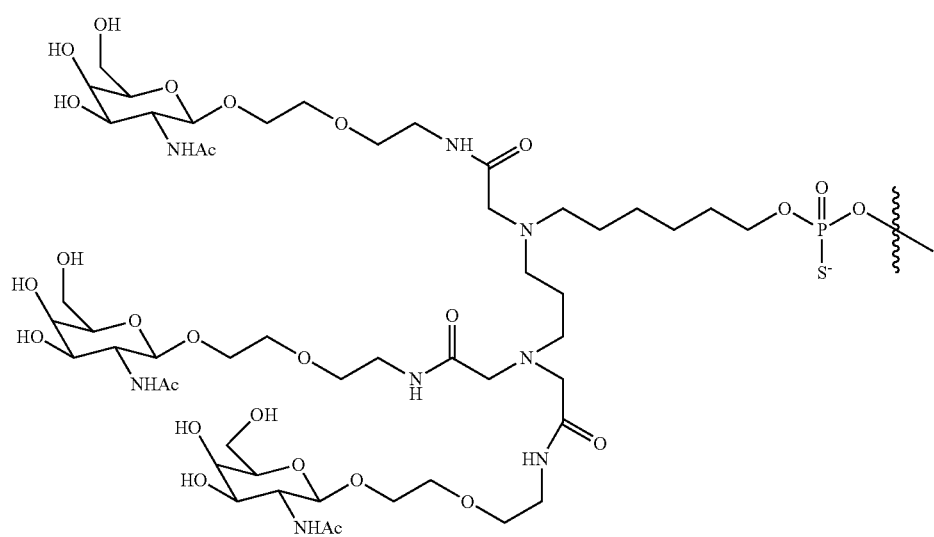
GLO-9
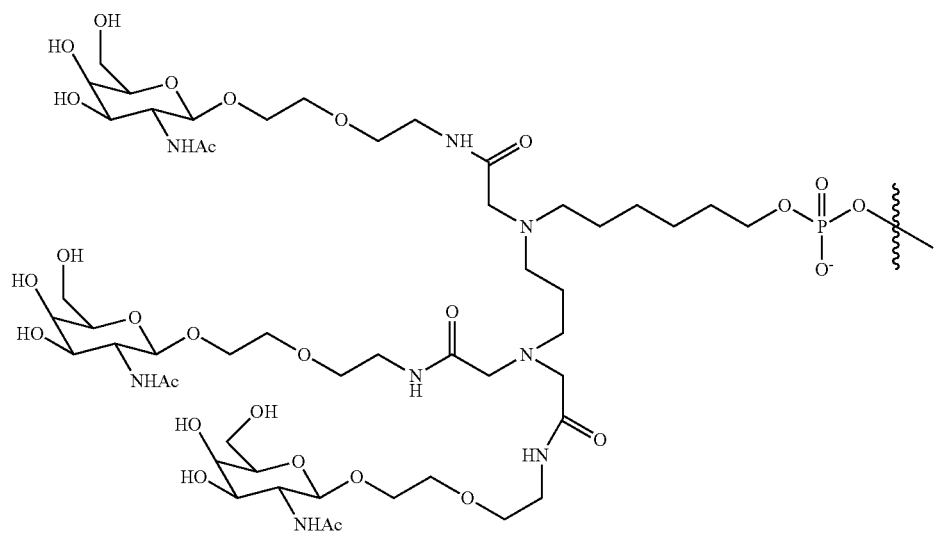

-continued
GLS-9
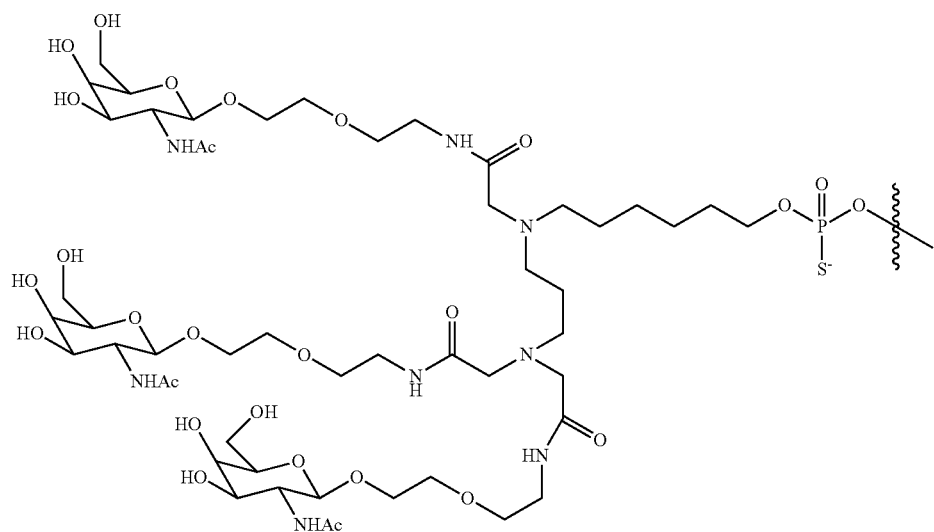
GLO-10
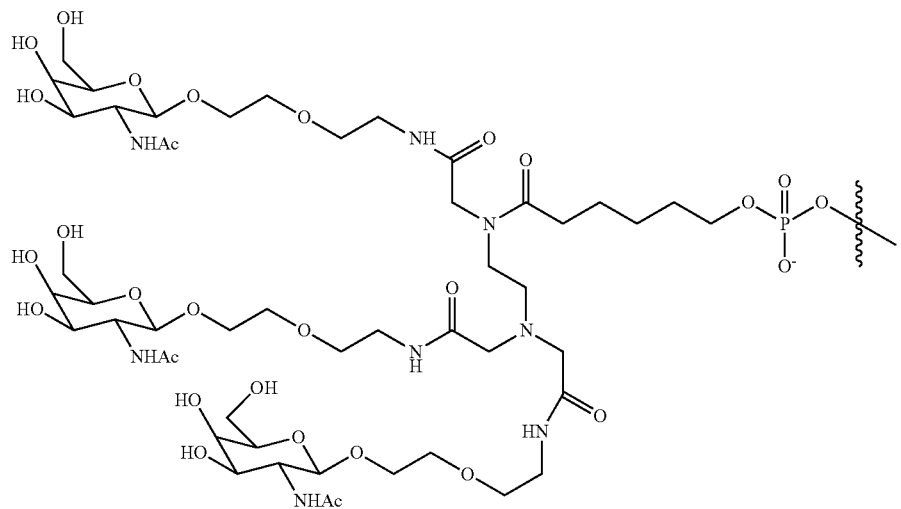
GLS-10
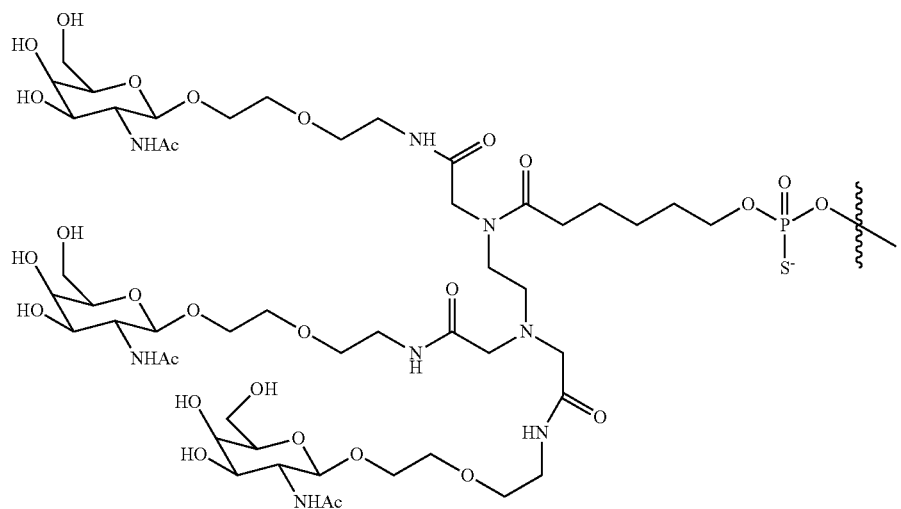

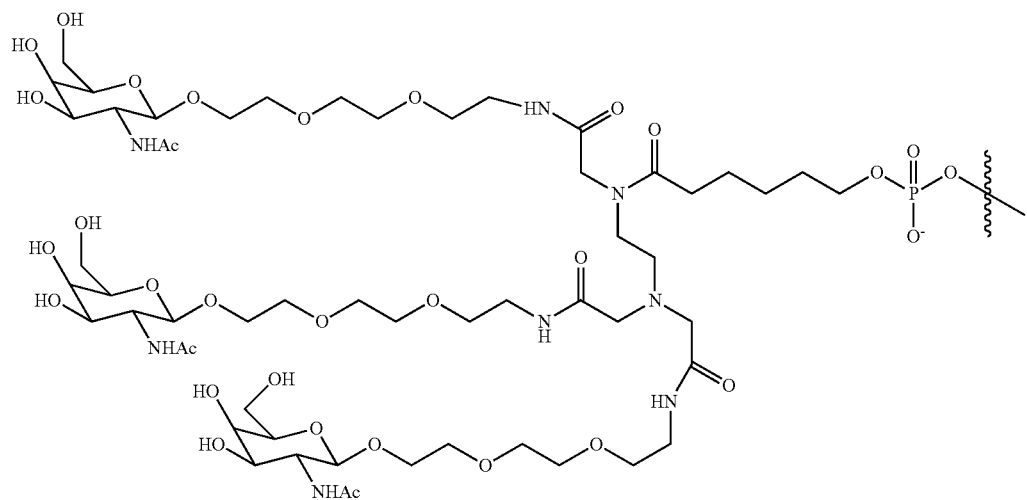
GLO-11
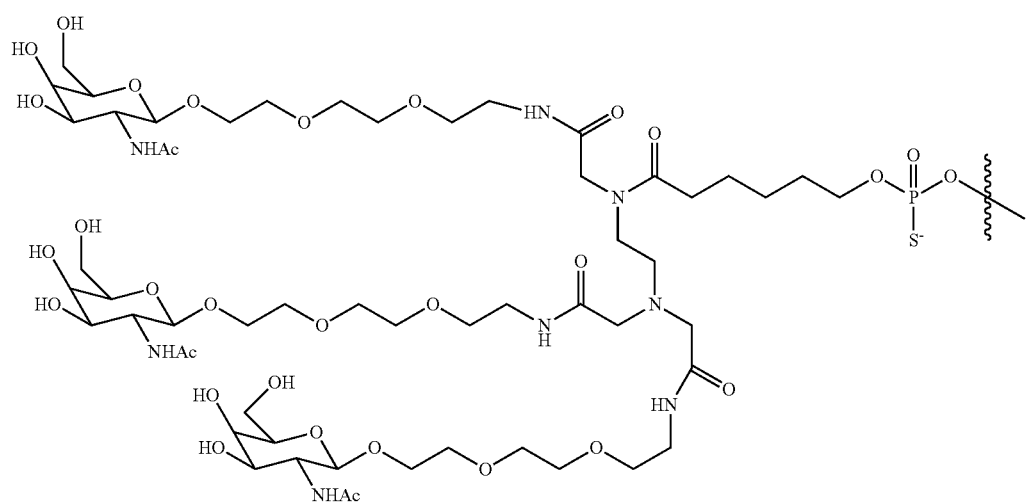
GLS-11
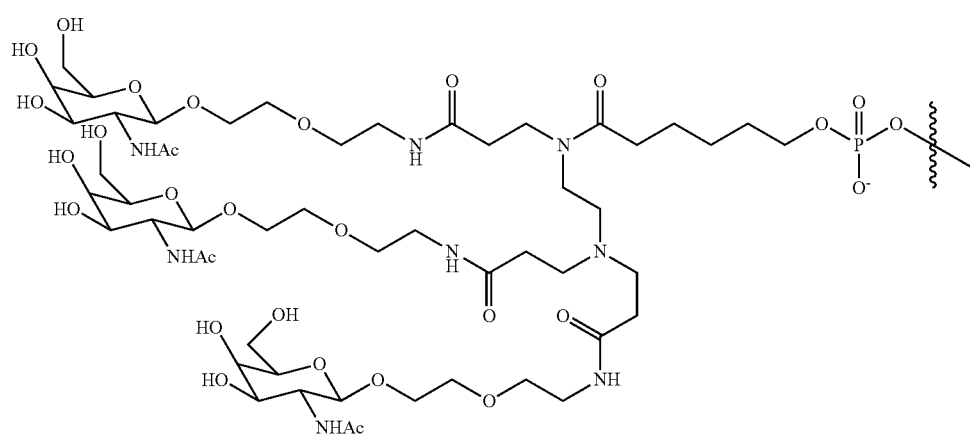
GLO-12

-continued
GLS-12
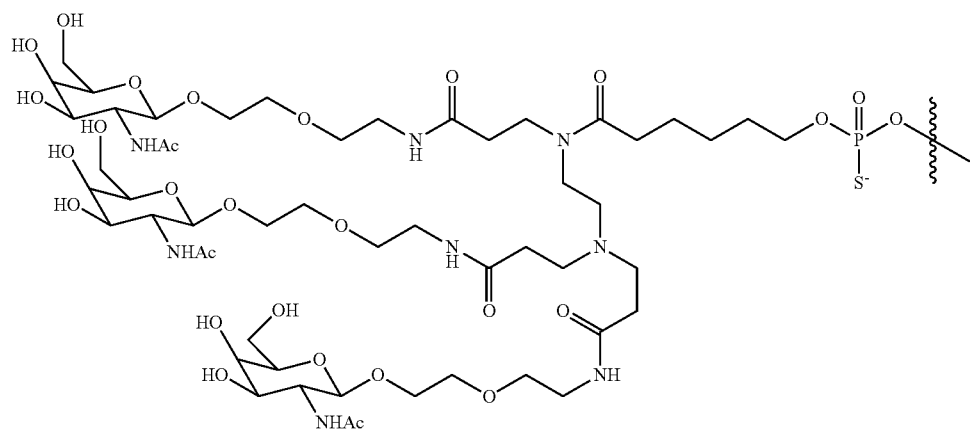
GLO-13
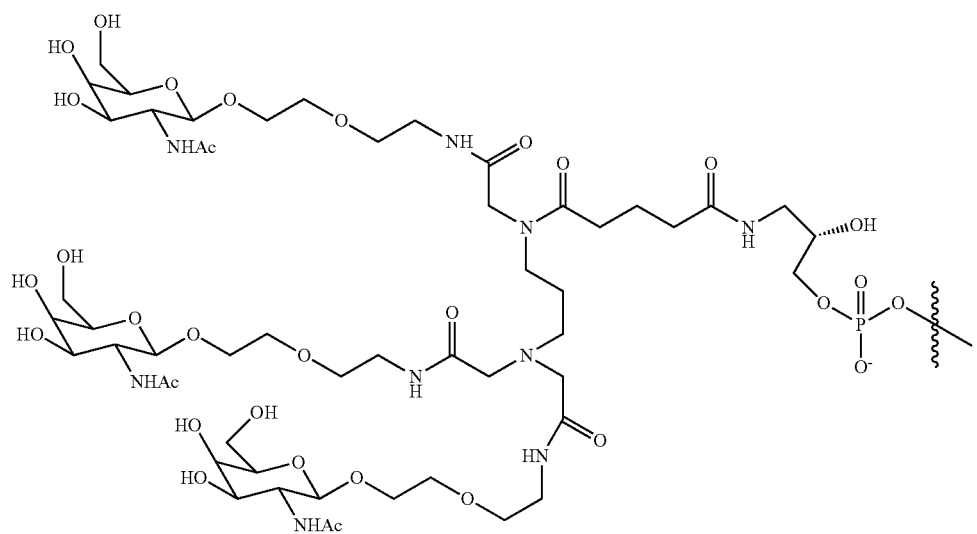
GLS-13
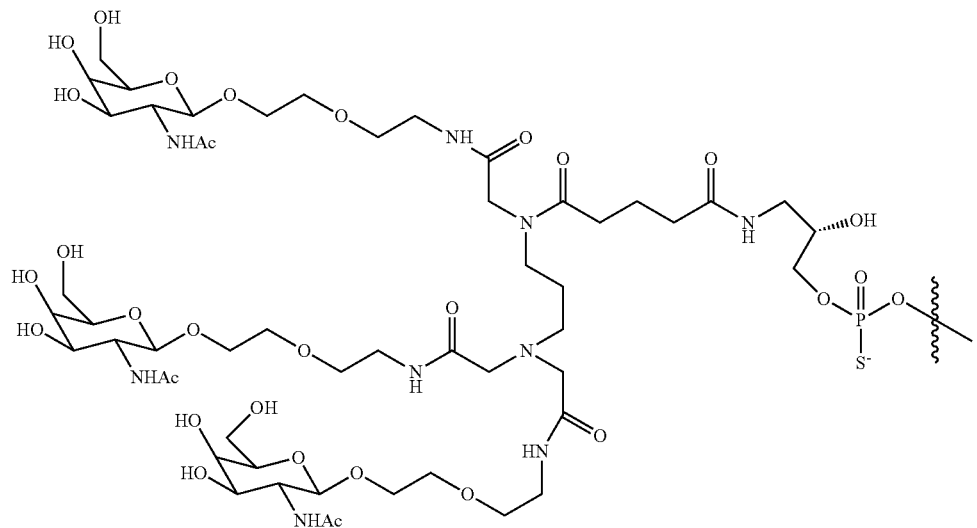

-continued
GLO-14
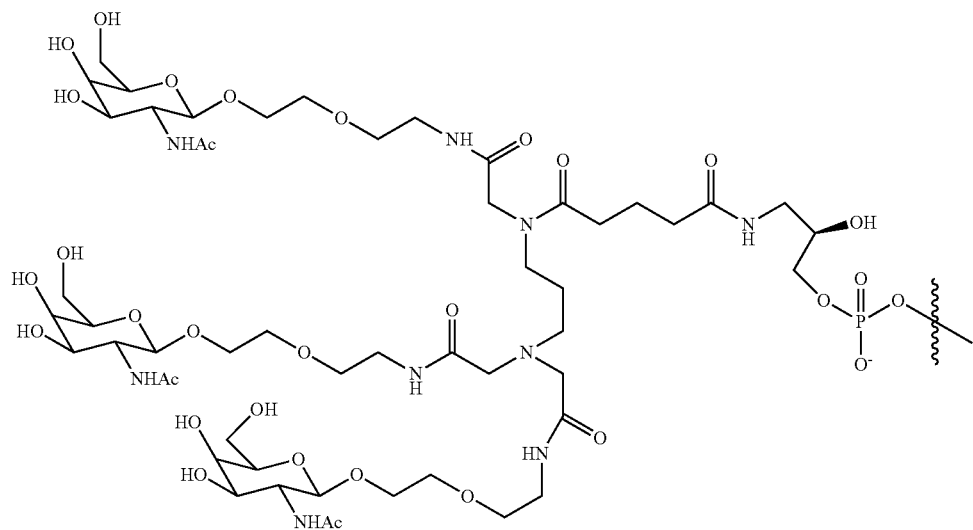
GLS-14
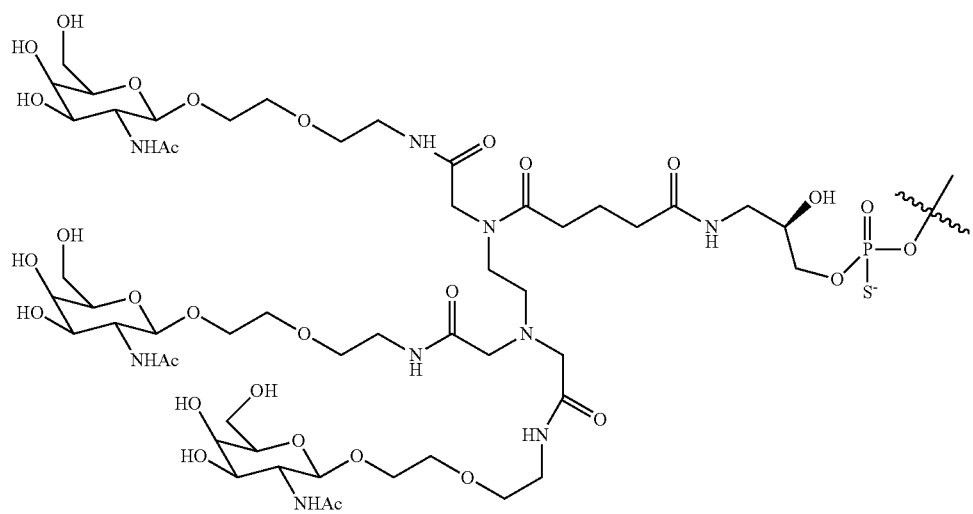
GLO-15
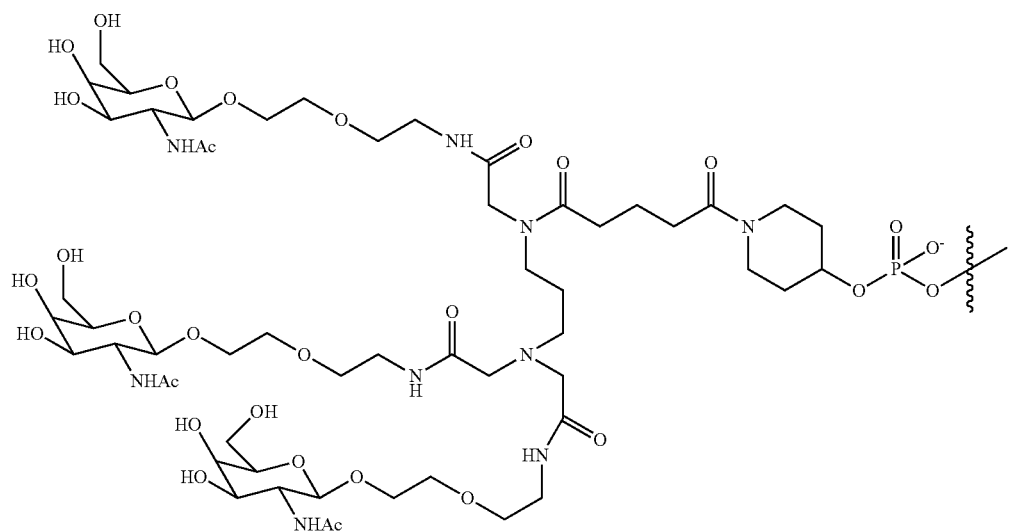

-continued
GLS-15
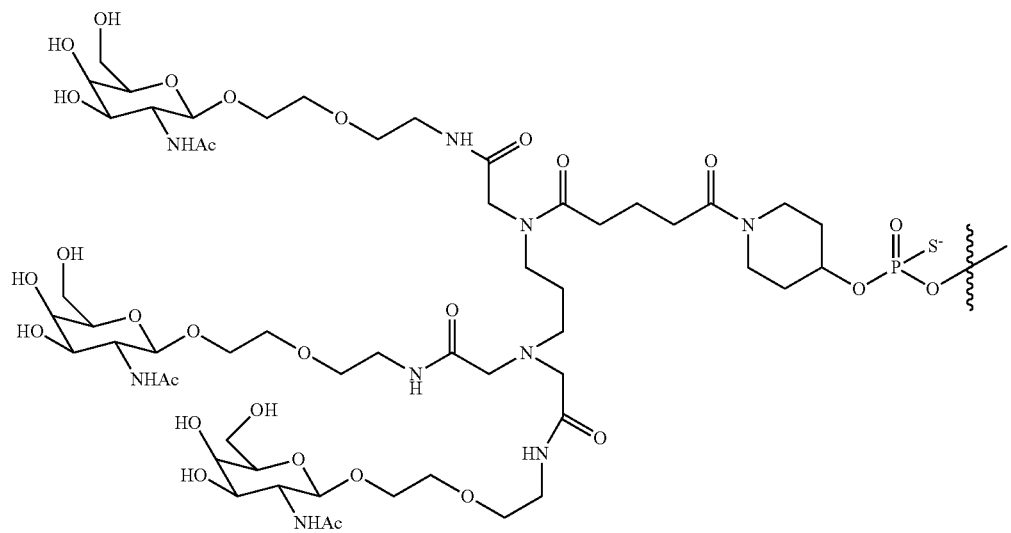
GLO-16
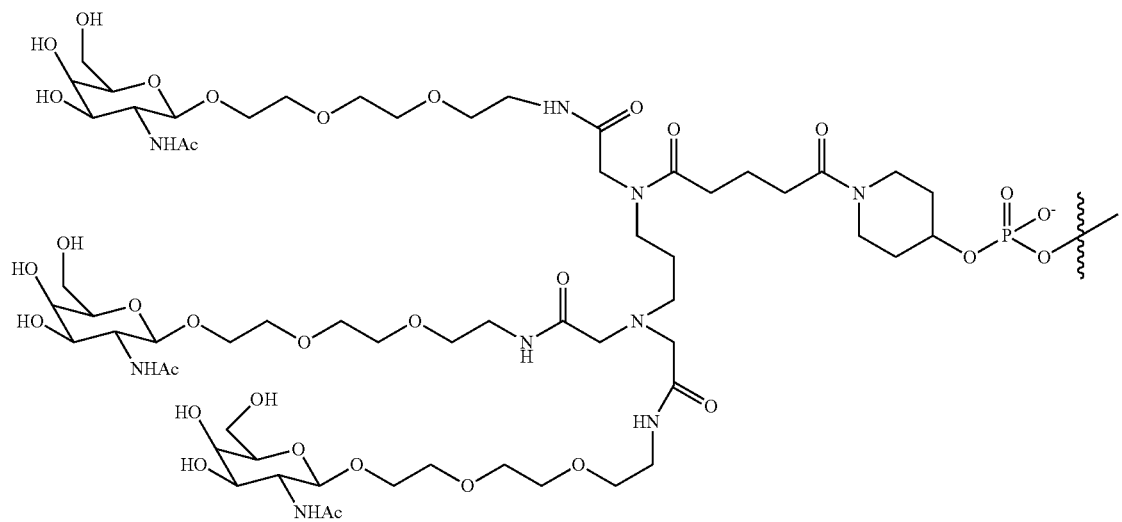
GLS-16
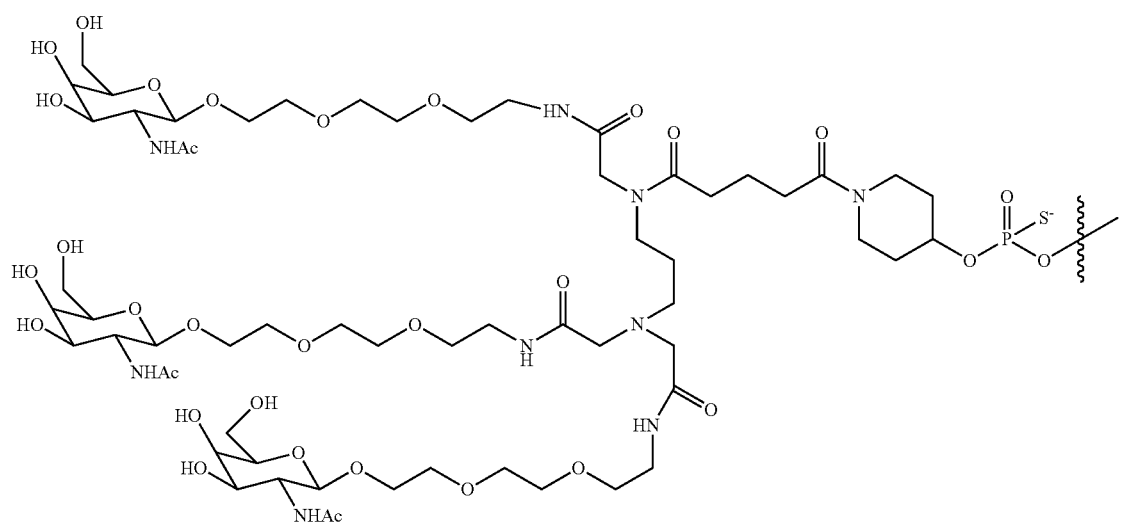
In some embodiments of the invention, in vivo delivery may also be by a beta-glucan delivery system, such as those described in U.S. Pat. Nos. 5,032,401 and 5,607,677, and U.S. Publication No. 2005/0281781, the entire contents of which are incorporated herein by reference. AGT RNAi agents can also be introduced into cells in vitro using methods known in the art such as electroporation and lipofection. In certain embodiments of the methods of the invention, an AGT dsRNA is delivered without a targeting agent. These RNAs can be delivered as "naked" RNA molecules. As a non-limiting example, an AGT dsRNA of the present invention can be administered to a subject in a pharmaceutical composition comprising an RNAi agent but not a targeting agent (e.g., a GalNAc targeting compound) to treat an AGT-associated disease or condition in the subject, such as hypertension.

It should be understood that in addition to certain delivery modalities described herein, other RNAi delivery modalities may be used in conjunction with embodiments of the AGT RNAi agents and therapeutic methods described herein, such as, but not limited to, those described herein and those used in the art.

AGT dsRNA agents of the invention can be administered to a subject in an amount and in a manner effective to reduce the level and activity of AGT polypeptide in a cell and/or subject. In some embodiments of the methods of the invention, one or more AGT dsRNA agents are administered to a cells and/or subject to treat a disease or condition associated with AGT expression and activity. In some embodiments, methods of the invention include administering one or more AGT dsRNA agents to a subject in need of such treatment so as to alleviate a disease or condition associated with AGT expression in the subject. An AGT dsRNA agent or AGT antisense polynucleotide agent of the invention can be administered to reduce AGT expression and/or activity in one or more of in vitro, ex vivo, and in vivo cells.

In some embodiments of the invention, the level of AGT polypeptide in a cell, and thus its activity, is reduced by delivering (e.g., introducing) an AGT dsRNA agent or AGT antisense polynucleotide agent into the cell. Targeting agents and methods can be used to facilitate the delivery of AGT dsRNA agents or AGT antisense polynucleotide agents to a specific cell type, cell subtype, organ, or spatial region within a subject and/or a subcellular region within a cell. AGT dsRNA agents can be, in certain methods of the invention, administered alone or in combination with one or more additional AGT dsRNA agents. In some embodiments, 2, 3, 4, or more independently selected AGT dsRNA agents are administered to the subject. In certain embodiments of the invention, an AGT dsRNA agent is administered to a subject to treat an AGT-associated disease or condition in combination with one or more additional therapeutic regimens for treating the AGT-associated disease or condition. Non-limiting examples of additional treatment regimens are administration of one or more AGT antisense polynucleotides of the invention, administration of non-AGT dsRNA therapeutics, and behavioral modification. An additional therapeutic regimen may be administered at one or more of the following times: prior to, simultaneously with, and after administration of the AGT dsRNA agent of the invention. It should be understood that "simultaneously" as used herein refers to within 5 minutes of time zero, within 10 minutes of time zero, within 30 minutes of time zero, within 45 minutes of time zero, and within 60 minutes of time zero, where "time zero" is the time at which the AGT dsRNA agent of the invention is administered to the subject. Non-limiting examples of non-AGT dsRNA therapeutics are: additional therapeutic agents such as diuretics, angiotensin-converting enzyme (ACE) inhibitors, angiotensin II receptor antagonists, beta-blockers, vasodilators, calcium channel blockers, aldosterone antagonists, alpha-2 agonists, renin inhibitors, alpha-blockers, peripherally acting adrenergic agents, selective D1 receptor partial agonists, non-selective alpha-adrenergic antagonists, synthetic, steroidal antimineralocorticoids, or combinations of any of the foregoing, and therapeutic agents for hypertension formulated into pharmaceutical combinations. Non-limiting examples of behavior modification are: dietary regimens, counseling, and exercise regimens. These and other therapeutic agents and behavior modifications are known in the art and may be used to treat AGT diseases or conditions in a subject, and may also be administered to a subject in combination with one or more AGT dsRNA agents of the invention to treat an AGT disease or condition. AGT dsRNA agents of the invention that are administered to a cell or subject to treat an AGT-associated disease or condition can act in a synergistic manner with one or more other therapeutic agents or active ingredients, thereby boosting the effectiveness of one or more therapeutic agents or active ingredients and/or increasing the effectiveness of the AGT dsRNA agent in treating an AGT-associated disease or condition.

The treatment method of the present invention comprises administration of an AGT dsRNA agent that may be used before the onset of and/or when an AGT-associated disease or condition is present, including early, middle, late stages of the disease or condition, and at all times before or after any of these stages. The methods of the present invention may also treat subjects who have been previously treated for an AGT-associated disease or condition with one or more other therapeutic agents and/or therapeutic active ingredients, wherein one or more other therapeutic agents and/or active ingredients were unsuccessful, minimally successful, and/or no longer successful in treating the subject's AGT-associated disease or condition.

Vector-Encoded dsRNA

In certain embodiments of the invention, a vector can be used to deliver the AGT dsRNA agent into cells. AGT dsRNA agent transcription units can be included in DNA or RNA vectors. The preparation and use of such transgene-encoding vectors for delivering sequences into a cell and/or subject is well known in the art. Vectors that result in transient expression of AGT dsRNA, for example, for at least 1, 2, 3, 4, 5, 6, 7, 8, 9, 10 or more hours, or at least 1, 2, 3, 4, 5, 6, 7, 8, 9, 10 or more weeks, can be used in the methods of the invention. The length of the transient expression can be determined using conventional methods based on factors such as, but not limited to, the specific vector construct selected and the target cell and/or tissue. Such transgenes can be introduced as linear constructs, circular plasmids or viral vectors, which can be integrating or non-integrating vectors. Transgenes can also be constructed so that they are inherited as extrachromosomal plasmids (Gassmann, et al., *Proc. Natl. Acad. Sci.* USA (1995) 92:1292).

One or more single strands of an AGT dsRNA agent can be transcribed from a promoter on an expression vector. Where two separate strands are to be expressed to generate, for example, dsRNA, two separate expression vectors can be co-introduced into the cell using means such as transfection or infection. In certain embodiments, each individual strand of the AGT dsRNA agent of the invention can be transcribed from promoters included on the same expression vector. In certain embodiments of the invention, the AGT dsRNA agent is expressed as inverted repeat polynucleotides linked by a linker polynucleotide sequence such that the AGT dsRNA agent has a stem and loop structure.

Non-limiting examples of RNA expression vectors are DNA plasmids or viral vectors. Expression vectors useful in embodiments of the invention may be compatible with eukaryotic cells. Eukaryotic expression vectors are routinely used in the art and are available from many commercial sources. Delivery of the AGT dsRNA expression vector may be systemic, such as by intravenous or intramuscular administration, by administration to target cells removed from the subject and then reintroduced into the subject, or by any means that allows the introduction of the desired target cells.

Viral vector systems that may be included in an embodiment of a method include, but are not limited to: (a) adenoviral vectors; (b) retroviral vectors, including but not limited to lentiviral vectors, Moloney murine leukemia virus, and the like; (c) adeno-associated virus vectors; (d) herpes simplex virus vectors; (e) SV40 vectors; (f) polyoma virus vectors; (g) papilloma virus vectors; (h) picornavirus vectors; (i) poxvirus vectors, such as orthopoxvirus vectors e.g. vaccinia virus vectors or avian poxvirus vectors, such as canary or fowl poxvirus vectors; (j) helper-dependent or gutless adenovirus vectors. Constructs for the recombinant expression of AGT dsRNA agents may contain regulatory elements such as promoters, enhancers, etc., which may be selected to provide constitutive or regulated/inducible expression. Viral vector systems and the use of promoters and enhancers, etc. are routine in the art and can be used in conjunction with the methods and compositions described herein.

Certain embodiments of the invention include the use of viral vectors to deliver AGT dsRNA agents into cells. A number of adenovirus-based delivery systems are routinely used in the art for delivery to, for example, the lungs, liver, central nervous system, endothelial cells, and muscle. Non-limiting examples of viral vectors that may be used in the methods of the invention are: AAV vectors, poxviruses such as vaccinia virus, modified virus Ankara (MVA), NYVAC, or avian poxviruses such as fowl or canary poxviruses.

Certain embodiments of the present invention include methods of delivering AGT dsRNA agents into cells using vectors, and such vectors may be in a pharmaceutically acceptable vector that may, but need not, include a sustained release matrix in which a gene delivery vector is embedded. In some embodiments, vectors for delivering AGT dsRNA can be produced by recombinant cells, and pharmaceutical compositions of the invention may include one or more cells that produce the AGT dsRNA delivery system.

Pharmaceutical Compositions Containing AGT dsRNA or ssRNA Agents

Certain embodiments of the invention include the use of pharmaceutical compositions containing an AGT dsRNA agent or an AGT antisense polynucleotide agent and a pharmaceutically acceptable carrier. Pharmaceutical compositions containing AGT dsRNA agents or AGT antisense polynucleotide agents can be used in the methods of the invention to reduce AGT gene expression and AGT activity in a cell, and can be used to treat AGT-associated diseases or conditions. Such pharmaceutical compositions can be formulated based on the mode of delivery. Non-limiting examples of formulations for delivery modes are: compositions formulated for subcutaneous delivery, compositions formulated for systemic administration by parenteral delivery, compositions formulated for intravenous (IV) delivery, compositions formulated for intrathecal delivery, and compositions formulated for direct delivery into the brain, and the like. The pharmaceutical compositions of the invention may be administered using one or more means to deliver the AGT dsRNA agent or AGT antisense polynucleotide agent into cells, for example: topical (e.g., via a transdermal patch); pulmonary, e.g., by inhalation or insufflation of a powder or aerosol, including via a nebulizer; intratracheal, intranasal, epidermal and transdermal, oral or parenteral. Parenteral administration includes: intravenous, intraarterial, subcutaneous, intraperitoneal or intramuscular injection or infusion; subcutaneous, for example by an implanted device; or intracranial, for example by intraparenchymal, intrathecal or intraventricular administration. AGT dsRNA agents or AGT antisense polynucleotide agents can also be delivered directly to target tissues, such as directly to the liver, directly to the kidneys, and the like. It will be understood that "delivering an AGT dsRNA agent" or "delivering an AGT antisense polynucleotide agent" to a cell includes delivering an AGT dsRNA agent or an AGT antisense polynucleotide agent, respectively, expressing the AGT dsRNA agent directly in the cell, as well as expressing the AGT dsRNA agent from an encoding vector delivered to the cell, or any suitable means that causes the AGT dsRNA or AGT antisense polynucleotide agent to be present in the cell. The preparation and use of formulations and means for delivering inhibitory RNA are well known and routinely used in the art.

As used herein, a "pharmaceutical composition" comprises a pharmacologically effective amount of an AGT dsRNA agent or AGT antisense polynucleotide agent of the invention and a pharmaceutically acceptable carrier. The term "pharmaceutically acceptable carrier" refers to a carrier used to administer a therapeutic agent. Such carriers include, but are not limited to, saline, buffered saline, glucose, water, glycerol, ethanol, and combinations thereof. This term specifically excludes cell culture media. For drugs administered orally, pharmaceutically acceptable carriers include, but are not limited to, pharmaceutically acceptable excipients, such as inert diluents, disintegrants, binders, lubricants, sweeteners, flavoring agents, coloring agents and preservatives.

Suitable inert diluents include sodium and calcium carbonate, sodium and calcium phosphate, and lactose, while cornstarch and alginic acid are suitable disintegrants. Binders may include starches and gelatin, while lubricants, if present, are usually magnesium stearate, stearic acid, or talc. If desired, the tablets may be coated with a material such as glyceryl monostearate or glyceryl distearate to delay absorption in the gastrointestinal tract. Agents included in pharmaceutical formulations are described further below. As used herein, terms such as "pharmacologically effective amount", "therapeutically effective amount", and "effective amount" refer to an amount of AGT dsRNA agent or AGT antisense polynucleotide agent of the invention that produces the intended pharmacological, therapeutic, or preventive outcome. For example, if a given clinical treatment is considered effective when it reduces a measurable parameter associated with a disease or disorder by at least 10%, then a therapeutically effective amount of a drug used to treat that disease or condition is the amount needed to reduce that parameter by at least 10%. For example, a therapeutically effective amount of an AGT dsRNA agent or an AGT antisense polynucleotide agent can reduce AGT polypeptide levels by at least 10%. Pharmaceutical compositions may comprise dsRNAi agents including duplexes such as AD00051 to AD00122-19-2, AD00163-3, AV01227 to AVAV01257, and AV01711 shown in Table 1. In some embodiments, preferred dsRNAi agents include, for example, duplexes AD00158, AD00163, AD00159, AD00290, AD00300, or AD00122. In other embodiments, preferred dsRNAi agents include, for example, AD00158-1, AD00158-2, AD00163-1, AD00159-1, or AD00300-1. In some other embodiments, such dsRNAi agents include duplex variants, e.g. variants of duplexes AD00158, AD00163, AD00163-3, AD00159, AD00290, AD00300 or AD00122.

Effective Amounts

In some aspects, methods of the invention include contacting a cell with an effective amount of an AGT dsRNA agent or an AGT antisense polynucleotide agent so as to reduce AGT gene expression in the contacted cell. Certain embodiments of the methods of present invention include administering to a subject an AGT dsRNA agent or an AGT antisense polynucleotide agent in an amount effective to reduce AGT gene expression and treat an AGT-associated disease or condition in the subject. Used for the purposes of reducing the expression of AGT and/or for treating AGT-associated diseases or conditions, an "effective amount" is an amount necessary or sufficient to realize a desired biological effect. For example, an effective amount of an AGT dsRNA agent or an AGT antisense polynucleotide agent to treat an AGT-associated disease or condition may be an amount required to: (1) slow or halt progression of the disease or condition; (ii) reverse, reduce, or eliminate one or more symptoms of the disease or condition. In some aspects of the invention, an effective amount is an amount of an AGT dsRNA agent or an AGT antisense polynucleotide agent that, when administered to a subject in need of treatment of an AGT-associated disease or condition, results in a therapeutic response preventing and/or treating the disease or condition. According to some aspects of the invention, an effective amount is an amount of an AGT dsRNA agent or AGT antisense polynucleotide agent of the invention that when combined or co-administered with another therapeutic treatment for an AGT-associated disease or condition, results in a therapeutic response preventing and/or treating the disease or condition. In some embodiments of the invention, a biological effect of treating a subject with an AGT dsRNA agent or AGT antisense polynucleotide agent of the invention may be an amelioration and/or complete elimination of symptoms caused by an AGT-associated disease or condition. In some embodiments of the invention, a biological effect is the complete abrogation of an AGT-associated disease or condition, for example, as demonstrated by a diagnostic test indicating that the subject does not have the AGT-associated disease or condition. Non-limiting examples of detectable physiological symptoms include a reduction in lipid accumulation in the liver of a subject following administration of an agent of the invention. Other art-known means of assessing the status of an AGT-associated disease or condition may be used to determine the effect of the agents and/or methods of the invention on AGT-associated diseases or conditions.

An effective amount of an AGT dsRNA agent or an AGT antisense polynucleotide agent that reduces the activity of an AGT polypeptide to a level that treats an AGT-associated disease or condition is typically determined in clinical trials in which an effective dose is established in a blinded study for a test population versus a control population. In some embodiments, an effective amount is an amount that results in a desired response, such as a reduction in AGT-associated disease or conditions in cells, tissues, and/or subjects suffering from the disease or condition. Accordingly, an effective amount of an AGT dsRNA agent or an AGT antisense polynucleotide agent for treating an AGT-associated disease or condition treatable by reducing AGT polypeptide activity can be an amount that, when administered, reduces the amount of AGT polypeptide activity in the subject to below the amount that would be present in the cell, tissue and/or subject without administration of the AGT dsRNA agent or AGT antisense polynucleotide agent. In certain aspects of the invention, the level of AGT polypeptide activity and/or AGT gene expression present in cells, tissues and/or subjects that have not been exposed to or administered an AGT dsRNA agent or AGT antisense polynucleotide agent of the invention is referred to as a "control" amount. In some embodiments of the methods of the invention, the control amount for a subject is a pre-treatment amount for the subject, in other words, the level in a subject prior to administration of the AGT agent can be the subject's control level, and used for comparison with a level of AGT polypeptide activity and/or AGT gene expression in the subject after administration of siRNA thereto. In the case of treating an AGT-associated disease or condition, the desired response may be to reduce or eliminate one or more symptoms of the disease or condition in the cells, tissue, and/or subject. The reduction or elimination can be temporary or permanent. It should be understood that methods of determining AGT polypeptide activity, AGT gene expression, symptom assessment, clinical testing, and the like can be used to monitor the status of an AGT-associated disease or condition. In some aspects of the invention, a desired response to treating an AGT-associated disease or condition is delaying, or even preventing, the onset of the disease or condition.

An effective amount of a compound that reduces the activity of an AGT polypeptide can also be determined by assessing the physiological effects of administration of an AGT dsRNA agent or AGT antisense polynucleotide agent on a cell or subject, such as a reduction in an AGT-associated disease or condition following administration. Assays and/or symptom monitoring in subjects can be used to determine the efficacy of the AGT dsRNA agents or AGT antisense polynucleotide agents of the invention (which can be administered in the pharmaceutical compounds of the invention), and to determine whether there is a response to treatment. A non-limiting example is one or more blood pressure tests known in the art. Another non-limiting example is that, before and after treating a subject with the AGT dsRNA agent of the invention, one or more blood pressure tests known in the art to determine the status of the subject's AGT-associated disorder. In another non-limiting example, one or more tests known in the art to lower blood pressure levels are used to determine the status of AGT-associated disease in a subject. In this example, the disease includes hypertension, and the test is used to determine a reduced blood pressure level in a subject before and after treatment with the AGT dsRNA agent of the invention.

Some embodiments of the invention include methods of determining the efficacy of a dsRNA agent or AGT antisense polynucleotide agent of the invention administered to a subject to treat an AGT-associated disease or condition by assessing and/or monitoring one or more "physiological characteristics" of the AGT-associated disease or condition in the subject. Non-limiting examples of physiological characteristics of an AGT-associated disease or condition are serum AGT levels, average blood pressure, and diastolic blood pressure in a subject. Standard methods for determining such physiological characteristics are known in the art and include, but are not limited to, blood tests, imaging studies, physical examinations, and the like.

It should be understood that the amount of AGT dsRNA agent or AGT antisense polynucleotide agent administered to a subject may be modified based at least in part on such determinations of disease and/or condition status and/or physiological characteristics determined by a subject. The therapeutic amount can be altered by, for example, by changing the composition in which an AGT dsRNA agent or AGT antisense polynucleotide agent is administered, by changing the route of administration, by changing the timing of administration, and so on, so as to increase or decrease the amount of the AGT-dsRNA agent or AGT antisense polynucleotide agent. The effective amount of an AGT dsRNA agent or AGT antisense polynucleotide agent will vary depending on the specific condition being treated, the age and medical condition of the subject treated, the severity of the condition, the duration of treatment, the nature of co-treatments (if any), the specific route of administration, and other factors within the health practitioner's knowledge and expertise. For example, the effective amount may depend on the desired level of AGT polypeptide activity and/or AGT gene expression effective in treating an AGT-associated disease or condition. A skilled artisan can empirically determine the effective amount of a particular AGT dsRNA agent or AGT antisense polynucleotide agent for use in the methods of the invention without undue experimentation. In conjunction with the teachings provided herein, by selecting from among the various AGT dsRNA agents or AGT antisense polynucleotide agents of the invention and weighing factors such as potency, relative bioavailability, patient body weight, severity of adverse side effects, and preferred mode of administration, it is possible to devise an effective prophylactic or therapeutic treatment regimen to effectively treat a specific subject. As used in embodiments of the invention, an effective amount of an AGT dsRNA agent or AGT antisense polynucleotide agent of the invention can be an amount that produces the desired biological effect in the cell when contacted therewith.

It should be appreciated that AGT gene silencing can be performed constitutively or by genome engineering in any cell expressing AGT, and determined by any suitable assay. In some embodiments of the invention, AGT gene expression is reduced by at least 5%, 6%, 7%, 8%, 9%, 10%, 15%, 20%, 25%, 30%, 35%, 40%, 45%, 50%, 55%, 60%, 65%, 70%, 75%, 80%, 85%, 90%, 95% or 100% by administering an AGT dsRNA agent of the invention. In some embodiments of the invention, AGT gene expression is reduced by 5% to 10%, 5% to 25%, 10% to 50%, 10% to 75%, 25% to 75%, 25% to 100% or 50% to 100% by administering an AGT dsRNA agent of the invention.

Dosing

AGT dsRNA agents and AGT antisense polynucleotide agents are delivered in pharmaceutical compositions in dosages sufficient to inhibit expression of AGT genes. In certain embodiments of the invention, a dose of AGT dsRNA agent or AGT antisense polynucleotide agent is 0.01 to 200.0 mg per kilogram of body weight of the recipient per day, typically 1 to 50 mg/kg body weight, 5 to 40 mg/kg body weight, 10 to 30 mg/kg body weight, 1 to 20 mg/kg body weight, 1 to 10 mg/kg body weight, or 4 to 15 mg/kg body weight per day, inclusive. For example, each single administration of an AGT dsRNA agent or an AGT antisense polynucleotide agent can be administered in a dose ranging from about 0.01 mg/kg, 0.05 mg/kg, 0.1 mg/kg, 0.2 mg/kg, 0.3 mg/kg, 0.4 mg/kg, 0.5 mg/kg, 1 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2 mg/kg, 2.1 mg/kg, 2.2 mg/kg, 2.3 mg/kg, 2.4 mg/kg, 2.5 mg/kg, 2.6 mg/kg, 2.7 mg/kg, 2.8 mg/kg, 2.9 mg/kg, 3.0 mg/kg, 3.1 mg/kg, 3.2 mg/kg, 3.3 mg/kg, 3.4 mg/kg, 3.5 mg/kg, 3.6 mg/kg, 3.7 mg/kg, 3.8 mg/kg, 3.9 mg/kg, 4 mg/kg, 4.1 mg/kg, 4.2 mg/kg, 4.3 mg/kg, 4.4 mg/kg, 4.5 mg/kg, 4.6 mg/kg, 4.7 mg/kg, 4.8 mg/kg, 4.9 mg/kg, 5 mg/kg, 5.1 mg/kg, 5.2 mg/kg, 5.3 mg/kg, 5.4 mg/kg, 5.5 mg/kg, 5.6 mg/kg, 5.7 mg/kg, 5.8 mg/kg, 5.9 mg/kg, 6 mg/kg, 6.1 mg/kg, 6.2 mg/kg, 6.3 mg/kg, 6.4 mg/kg, 6.5 mg/kg, 6.6 mg/kg, 6.7 mg/kg, 6.8 mg/kg, 6.9 mg/kg, 7 mg/kg, 7.1 mg/kg, 7.2 mg/kg, 7.3 mg/kg, 7.4 mg/kg, 7.5 mg/kg, 7.6 mg/kg, 7.7 mg/kg, 7.8 mg/kg, 7.9 mg/kg, 8 mg/kg, 8.1 mg/kg, 8.2 mg/kg, 8.3 mg/kg, 8.4 mg/kg, 8.5 mg/kg, 8.6 mg/kg, 8.7 mg/kg, 8.8 mg/kg, 8.9 mg/kg, 9 mg/kg, 9.1 mg/kg, 9.2 mg/kg, 9.3 mg/kg, 9.4 mg/kg, 9.5 mg/kg, 9.6 mg/kg, 9.7 mg/kg, 9.8 mg/kg, 9.9 mg/kg, 10 mg/kg, 11 mg/kg, 12 mg/kg, 13 mg/kg, 14 mg/kg, 15 mg/kg, 16 mg/kg, 17 mg/kg, 18 mg/kg, 19 mg/kg, 20 mg/kg, 21 mg/kg, 22 mg/kg, 23 mg/kg, 24 mg/kg, 25 mg/kg, 26 mg/kg, 27 mg/kg, 28 mg/kg, 29 mg/kg, 30 mg/kg, 31 mg/kg, 32 mg/kg, 33 mg/kg, 34 mg/kg, 35 mg/kg, 36 mg/kg, 37 mg/kg, 38 mg/kg, 39 mg/kg, 40 mg/kg, 41 mg/kg, 42 mg/kg, 43 mg/kg, 44 mg/kg, 45 mg/kg, 46 mg/kg, 47 mg/kg, 48 mg/kg, 49 mg/kg to 50 mg/kg body weight.

Various factors can be considered when determining the dosage and timing of delivery of the AGT dsRNA agents of the invention. The absolute amount of AGT dsRNA agent or AGT antisense polynucleotide agent delivered will depend on a variety of factors, including co-treatment, number of doses, and individual subject parameters including age, physical condition, size, and weight. These factors are well known to one of ordinary skill in the art and can be addressed by means of routine experimentation. In some embodiments, a maximum dose may be used, i.e. the highest safe dose according to sound medical judgment.

In some embodiments, methods of the invention may comprise administering to a subject 1, 2, 3, 4, 5, 6, 7, 8, 9, 10 or more doses of an AGT dsRNA agent or AGT antisense polynucleotide agent. In some cases, a dose of a pharmaceutical compound (e.g., comprising an AGT dsRNA agent or comprising an AGT antisense polynucleotide agent) may be administered to the subject at least daily, every other day, weekly, every other week, monthly, etc. Does may be administered once or more than once per day, for example 2, 3, 4, 5 or more times in a 24 hour period. A pharmaceutical composition of the present invention can be administered once daily; or the AGT dsRNA agent or AGT antisense polynucleotide agent can be administered in two, three or more sub-doses at appropriate intervals throughout the day, or even using continuous infusion or delivery via a controlled release formulation. In some embodiments of the methods of the invention, a pharmaceutical composition of the invention is administered to the subject once or more daily, once or more weekly, once or more monthly, or once or more annually.

In certain aspects, methods of the invention include administering a pharmaceutical compound alone, in combination with one or more other AGT dsRNA agents or AGT antisense polynucleotide agents, and/or in combination with other drug therapies or treatment activities or regimens administered to a subject suffering from an AGT-associated disease or condition. Pharmaceutical compounds can be administered in the form of pharmaceutical compositions. Pharmaceutical compositions used in the methods of the present invention may be sterile and contain an amount of an AGT dsRNA agent or an AGT antisense polynucleotide agent that will reduce the activity of the AGT polypeptide to a level sufficient to produce the desired response in a unit of weight or volume suitable for administration to the subject. The dosage of a pharmaceutical composition comprising an AGT dsRNA agent or an AGT antisense polynucleotide agent administered to a subject to reduce AGT protein activity may be selected according to different parameters, particularly the mode of administration used and the state of the subject. Other factors include the duration of treatment required. If the subject's response at the initial dose is insufficient, a higher dose may be administered (or the dose may be effectively increased via a different, more local delivery route) insofar as this is tolerated by the patient.

Treatment

As used herein, the term "prevention" or "prevent" when used to refer to a disease, disorder, or condition thereof that would benefit from reduced expression of the AGT gene, means that a subject is less likely to develop symptoms associated with such disease, disorder, or condition, which are for example, symptoms caused by or associated with activation of the renin-angiotensin-aldosterone system (RAAS), such as hypertension. In such situations, the likelihood of developing hypertension is decreased: for example, prevention is considered effective when an individual has one or more risk factors for hypertension but does not develop hypertension or only develops less severe hypertension, or fails to develop a disease, condition, or condition, or the development of symptoms associated with such disease, condition, or condition is reduced (e.g., a reduction in a scale for the disease or condition by at least 10% in a clinical setting) relative to a population with the same risk factors who do not receive treatment as described herein, or delays the manifestation of symptoms (e.g., by days, weeks, months, or years).

Based on the average of correctly measured seated blood pressure readings during two or more visits, a normotensive subject has a systolic blood pressure of about 90-119 mmHg (about 12-15.9 kPa ($KN/m^2$)) and a diastolic blood pressure of about 60-79 mmHg (about 8.0-10.5 kPa ($kN/m^2$)). Subjects with prehypertension have systolic blood pressure of about 120-139 mmHg (about 16.1-18.5 kPa ($kN/m^2$)) and diastolic blood pressure of about 60-79 mmHg (about 8.0-10.5 kPa ($kN/m^2$)); subjects with hypertension (e.g., stage I hypertension) have systolic blood pressure of about 140-159 mmHg (about 18.7-21.2 kPa ($kN/m^2$)) and diastolic blood pressure of about 90-99 mmHg (about 12.0-13.2 kPa ($kN/m^2$)); subjects with hypertension (e.g., stage II hypertension) have systolic blood pressure of about ≥160 mmHg (about ≥21.3 kPa ($kN/m^2$)) and diastolic blood pressure of about ≥100 mmHg (about ≥13.3 kPa ($kN/m^2$)).

In certain embodiments, the angiotensinogen-related disease is essential hypertension. "Essential hypertension" is the result of environmental or genetic factors (for example, the result of no obvious underlying medical cause).

In certain embodiments, the angiotensinogen-related disease is secondary hypertension. "Secondary hypertension" has an identifiable underlying condition and can have multiple etiologies, including renal, vascular, and endocrine causes, for example renal parenchymal disease (e.g., polycystic kidney disease, glomerular or interstitial disease), renal vascular disease (e.g. renal artery stenosis, fibromuscular dysplasia), endocrine disorders (e.g. adrenocorticoid or mineralocorticoid excess, pheochromocytoma, hyperthyroidism or hypothyroidism, growth hormone excess, parathyroid hyperthyroidism), coarctation of the aorta, or use of oral contraceptives.

In certain embodiments, the angiotensinogen-related disease is a hypertensive emergency, such as malignant hypertension and accelerated hypertension. "Accelerated hypertension" refers to a severe increase in blood pressure (i.e., equal to or greater than 180 mmHg systolic blood pressure or 110 mmHg diastolic blood pressure) accompanied by direct damage to one or more end organs. Blood pressure must be lowered immediately to prevent further organ damage. "Malignant hypertension" refers to a severely elevated blood pressure (i.e., equal to or greater than 180 mmHg systolic blood pressure or 110 mmHg diastolic blood pressure) accompanied by direct damage to one or more end organs and papilledema. Blood pressure must be lowered immediately to prevent further organ damage. Nerve end-organ damage due to uncontrolled blood pressure may include hypertensive encephalopathy, cerebrovascular accident/cerebral infarction, subarachnoid hemorrhage and/or intracranial hemorrhage. Cardiovascular end-organ injury may include myocardial ischemia/infarction, acute left ventricular dysfunction, acute pulmonary edema, and/or aortic dissection. Other organ systems may also be affected by uncontrolled hypertension, which can lead to acute renal failure/insufficiency, retinopathy, eclampsia, or microangiopathic hemolytic anemia.

In certain embodiments, the angiotensinogen-related disease is acute hypertension. "Acute hypertension" refers to a severe increase in blood pressure (i.e., equal to or greater than 180 mmHg systolic blood pressure or 110 mmHg diastolic blood pressure) without direct damage to one or more organs. Blood pressure can be safely lowered within a few hours.

In certain embodiments, the angiotensinogen-related disease is pregnancy-related hypertension, such as chronic hypertension of pregnancy, gestational hypertension, preeclampsia, eclampsia, preeclampsia superimposed on chronic hypertension, HELLP syndrome, and pregnancy-induced hypertension (also called transient hypertension of pregnancy, chronic hypertension found in the second half of pregnancy, and pregnancy-induced hypertension (PIH)). A subject with "chronic hypertension of pregnancy" is a subject whose blood pressure exceeds 140/90 mm Hg before pregnancy or before 20 weeks of pregnancy. "Gestational hypertension" or "pregnancy-induced hypertension" refers to hypertension that develops late in pregnancy (>20 weeks' gestation) without any other features of preeclampsia and that returns to normal after delivery. "Mild preeclampsia" is defined as two episodes of hypertension (blood pressure≥140/90 mm Hg) occurring at least six hours apart in a normotensive woman before 20 weeks of gestation, but without evidence of end-organ damage. In subjects with preexisting essential hypertension, preeclampsia is diagnosed if systolic blood pressure increases by 30 mmHg or diastolic blood pressure increases by 15 mmHg. "Severe preeclampsia" is defined as the presence of one of the following signs or symptoms of preeclampsia: two episodes of systolic blood pressure of 160 mmHg or greater or a diastolic blood pressure of 110 mmHg or greater at least 6 hours apart; proteinuria more than 5 g collected over 24 hours or more than 3+ in two random urine samples collected at least 4 hours apart; pulmonary edema or cyanosis; oliguria (<400 mL in 24 hours); persistent headache, epigastric pain, and/or impaired liver function; thrombocytopenia, oligohydramnios, reduced fetal growth, or placental abruption. "Eclampsia" is defined as seizures that cannot be attributed to other causes in women with preeclampsia. "HELLP syndrome" (also known as edema-proteinuria-hypertension gestosis type B) refers to hemolysis, elevated liver enzyme levels, and decreased platelet levels in pregnant subjects.

In certain embodiments, the angiotensinogen-related disease is resistant hypertension. "Resistant hypertension" refers to blood pressure that remains above target (e.g., 140/90 mmHg) despite concurrent use of three different classes of antihypertensive drugs, one of which is a thiazide diuretic. Subjects who controlled their blood pressure with four or more medications are also considered to have resistant hypertension.

AGT-associated diseases and conditions in which a reduction in the level and/or activity of an AGT polypeptide is effective in treating the disease or condition can be treated using the methods and AGT dsRNA agents of the invention to inhibit AGT expression. Examples of diseases and conditions that can be treated with the AGT dsRNA agents or AGT antisense polynucleotide agents of the invention and the treatment methods of the invention include, but are not limited to: hypertensive disease, hypertension, borderline hypertension, essential hypertension, secondary hypertension, isolated systolic or diastolic hypertension, pregnancy-associated hypertension, diabetic hypertension, resistant hypertension, refractory hypertension, paroxysmal hypertension, renovascular hypertension, Goldblatt hypertension, ocular hypertension, glaucoma, pulmonary hypertension, portal hypertension, systemic venous hypertension, systolic hypertension, unstable hypertension, hypertensive heart disease, hypertensive nephropathy, atherosclerosis, arteriosclerosis, vascular disease, diabetic nephropathy, diabetic retinopathy, chronic heart failure, cardiomyopathy, diabetic cardiomyopathy, glomerulosclerosis, aortic stenosis, aortic aneurysm, ventricular fibrosis, heart failure, myocardial infarction, angina, stroke, renal disease, renal failure, systemic sclerosis, intrauterine growth retardation (IUGR), and fetal growth restriction. Such diseases and conditions may be referred to herein as "AGT-associated diseases and conditions" and "diseases and conditions caused and/or modulated by AGT".

In certain aspects of the invention, an AGT dsRNA agent or AGT antisense polynucleotide agent of the invention can be administered to a subject at one or more times before or after diagnosis of an AGT-associated disease or condition. In some aspects of the invention, the subject is at risk of suffering from or developing an AGT-associated disease or condition. A subject at risk of developing an AGT-associated disease or condition is a subject who has an increased likelihood of developing an AGT-associated disease or condition compared to a control risk of developing an AGT-associated disease or condition. In some embodiments of the invention, the level of risk is statistically significant compared to a control level of risk. A subject at risk may include, for example: a subject who is or will be a subject with a pre-existing disease and/or genetic abnormality that renders the subject more susceptible to developing an AGT-associated disease or condition than a control subject without the pre-existing disease or genetic abnormality; subjects with a family and/or personal history of AGT-associated diseases or conditions; and subjects who have been previously treated for AGT-associated diseases or conditions. It should be understood that a pre-existing disease and/or genetic abnormality that renders a subject more susceptible to an AGT-associated disease or condition may be a disease or genetic abnormality that, when present, has been previously determined to be associated with a higher likelihood of the development of an AGT-associated disease or condition.

It should be understood that an AGT dsRNA agent or AGT antisense polynucleotide agent may be administered to a subject based on the medical condition of the individual subject. For example, health care provided to a subject may evaluate AGT levels measured in a sample obtained from the subject and determine that it is desirable to reduce the subject's AGT levels by administering an AGT dsRNA agent or AGT antisense polynucleotide agent of the invention. In one non-limiting example, a biological sample, such as a blood or serum sample, can be obtained from a subject and the subject's AGT level determined in the sample. Administering an AGT dsRNA agent or AGT antisense polynucleotide agent to a subject, and obtaining a blood or serum sample from the subject after administration, and using the sample to determine AGT levels, and comparing the results to the subject's pre-dose (previous) sample. A decrease in a subject's AGT levels in subsequent samples compared to pre-dose levels is indicative of the efficacy of the administered AGT dsRNA agent or AGT antisense polynucleotide agent in reducing the subject's AGT levels. In one non-limiting example, blood pressure may be considered a physiological characteristic of an AGT-associated disorder, even if the subject has not been diagnosed with an AGT-associated disorder, such as those disclosed herein. A healthcare provider can monitor changes in a subject's blood pressure as a measure of the efficacy of an administered AGT dsRNA agent or AGT antisense polynucleotide agent of the invention.

Certain embodiments of the methods of the present invention include modifying a treatment comprising administering a dsRNA agent or AGT antisense polynucleotide agent of the invention to a subject based at least in part on an assessment of a change in one or more physiological characteristics of an AGT-associated disease or condition in the subject. For example, in some embodiments of the invention, the effect of a dsRNA agent or AGT antisense polynucleotide agent of the invention administered to a subject can be determined and used to help modulate the amount of dsRNA agent or AGT antisense polynucleotide agent of the invention subsequently administered to the subject. In one non-limiting example, a dsRNA agent or an AGT antisense polynucleotide agent of the invention is administered to a subject, the subject's blood pressure is determined after administration, and based at least in part on the determined levels, it is determined whether a higher amount of dsRNA agent or AGT antisense polynucleotide agent is required to enhance the physiological effect of the administered agent, such as lowering or further lowering the blood pressure of the subject. In another non-limiting example, a dsRNA agent or AGT antisense polynucleotide agent of the invention is administered to a subject, the subject's blood pressure is determined after administration, and based at least in part on the determined levels, administering a lower amount of dsRNA agent or AGT antisense polynucleotide agent is expected.

Accordingly, some embodiments of the invention include assessing changes in one or more physiological characteristics resulting from prior treatment of a subject to adjust the amount of a dsRNA agent or AGT antisense polynucleotide agent of the invention subsequently administered to the subject. Some embodiments of the methods of the invention include 1, 2, 3, 4, 5, 6 or more determinations of physiological characteristics of an AGT-associated disease or condition; assessing and/or monitoring the efficacy of an administered AGT dsRNA agent or AGT antisense polynucleotide agent of the invention; and optionally using the determined results to adjust one or more of the dosage, dosing regimen, and/or dosing frequency of the dsRNA agent or AGT antisense polynucleotide agent of the invention for treating an AGT-associated disease or condition in the subject. In some embodiments of the methods of the invention, the desired result of administering to a subject an effective amount of a dsRNA agent or an AGT antisense polynucleotide agent of the invention is a decrease in the subject's blood pressure as compared to a previous blood pressure determined for the subject, or a blood pressure within the normal blood pressure range.

As used herein, the terms "treatment", "therapeutic" or "treated" when used in reference to an AGT-associated disease or condition may refer to a prophylactic treatment that decrease the likelihood of a subject developing the AGT-associated disease or condition, and may also refer to a treatment after the subject has developed an AGT-associated disease or condition in order to eliminate or reduce the level of the AGT-associated disease or condition, prevent the AGT-associated disease or condition from becoming more severe, and/or slow the progression of the AGT-associated disease or condition in a subject as compared to the subject in the absence of the therapy to reduce AGT polypeptide activity in the subject.

Certain embodiments of agents, compositions, and methods of the invention can be used to inhibit AGT gene expression. As used herein, with respect to the expression of the AGT gene, the terms "inhibit," "silence," "reduce," "down-regulate," and "knockdown" refer to altering the expression of the AGT gene, for example, by one or more of the following: a level of RNA transcribed from the gene, a level of activity of AGT expressed, and a level of AGT polypeptide, protein or protein subunit translated from the mRNA in a cell, group of cells, tissue, organ, or subject in which the AGT gene is transcribed, is reduced when the cell, group of cells, tissue, organ, or subject is exposed to (e.g., treated with) an AGT dsRNA agent or AGT antisense polynucleotide agent of the invention, as compared to a control level of RNA transcribed from the AGT gene, a level of activity of expressed AGT, or a level of AGT translated from the mRNA, respectively. In some embodiments, the control level is the level in a cell, tissue, organ or subject that has not been exposed to (e.g., treated with) an AGT dsRNA agent or an AGT antisense polynucleotide agent.

Administration Methods

Various routes of administration of AGT dsRNA agents or AGT antisense polynucleotide agents can be used in the methods of the invention. The selection of a particular delivery mode will depend, at least in part, on the specific condition being treated and the dosage required for therapeutic efficacy. In general, the methods of the present invention may be practiced using any mode of administration that is medically acceptable, meaning any mode that produces effective therapeutic levels for AGT-associated diseases or conditions without causing clinically unacceptable side effects. In some embodiments of the invention, an AGT dsRNA agent or AGT antisense polynucleotide agent may be administered via an oral, enteral, mucosal, subcutaneous, and/or parenteral route. The term "parenteral" includes subcutaneous, intravenous, intrathecal, intramuscular, intraperitoneal and intrasternal injection or infusion techniques. Other routes include, but are not limited to, nasal (e.g., via a gastronasal tube), transdermal, vaginal, rectal, sublingual, and inhalation. Delivery routes of the present invention may include intrathecal, intraventricular, or intracranial. In some embodiments of the invention, an AGT dsRNA agent or AGT antisense polynucleotide agent can be placed in a slow release matrix and administered by placing the matrix in a subject. In some aspects of the invention, AGT dsRNA agents or AGT antisense polynucleotide agents may be delivered to cells of a subject using nanoparticles coated with a delivery agent that targets specific cells or organelles. A variety of delivery modes, methods, and reagents are known in the art. Non-limiting examples of delivery methods and delivery agents are provided elsewhere herein. In some aspects of the invention, the term "delivery" with respect to an AGT dsRNA agent or an AGT antisense polynucleotide agent may refer to the administration of one or more "naked" AGT dsRNA agent or AGT antisense polynucleotide agent sequences to a cell or subject. In certain aspects of the invention, "delivery" means administering to a cell or subject by transfection, delivering a cell comprising an AGT dsRNA agent or an AGT antisense polynucleotide agent to a subject, or delivering a vector encoding an AGT dsRNA agent or AGT antisense polynucleotide agent to a cell and/or subject and the like. Delivery of an AGT dsRNA agent or AGT antisense polynucleotide agent using transfection may include administration of a vector to a cell and/or subject.

In some methods of the invention, one or more AGT dsRNA agents or AGT antisense polynucleotide agents may be administered in the form of a preparation or in a pharmaceutically acceptable solution, which may typically contain pharmaceutical acceptable concentrations of salts, buffers, preservatives, compatible carriers, adjuvants, and optionally other therapeutic ingredients. In some embodiments of the invention, an AGT dsRNA agent or AGT antisense polynucleotide agent can be formulated with another therapeutic agent for simultaneous administration. According to the methods of the present invention, the AGT dsRNA agent or AGT antisense polynucleotide agent can be administered in the form of a pharmaceutical composition. Typically, pharmaceutical compositions comprise an AGT dsRNA agent or AGT antisense polynucleotide agent and optionally a pharmaceutically acceptable carrier. Pharmaceutically acceptable carriers are well known to those of ordinary skill in the art. As used herein, a pharmaceutically acceptable carrier refers to a nontoxic material that does not interfere with the effectiveness of the biological activity of the active ingredient (e.g., the ability of an AGT dsRNA agent or an AGT antisense polynucleotide agent to inhibit AGT gene expression in a cell or subject). Various methods of administering and delivering dsRNA agents or AGT antisense polynucleotide agents for therapeutic use are known in the art and can be used in the methods of the invention.

Pharmaceutically acceptable carriers include diluents, fillers, salts, buffers, stabilizers, solubilizers and other materials known in the art. Exemplary pharmaceutically acceptable carriers are described in U.S. Pat. No. 5,211,657, and other carriers are known to those skilled in the art. Such preparations may generally contain salts, buffers, preservatives, compatible carriers, and optionally other therapeutic agents. When used in medicine, the salts should be pharmaceutically acceptable, but non-pharmaceutically acceptable salts can be conveniently used to prepare pharmaceutically acceptable salts thereof and are not excluded from the scope of the present invention. Such pharmacologically and pharmaceutically acceptable salts include, but are not limited to, salts prepared from the following acids: hydrochloric acid, hydrobromic acid, sulfuric acid, nitric acid, phosphoric acid, maleic acid, acetic acid, salicylic acid, citric acid, formic acid, malonic acid, succinic acid, and the like. Further, pharmaceutically acceptable salts may be prepared as alkali metal salts or alkaline earth metal salts, such as sodium, potassium or calcium salts.

Some embodiments of the methods of the invention include administering one or more AGT dsRNA agents or AGT antisense polynucleotide agents directly to a tissue. In some embodiments. the tissue to which the compound is administered is a tissue in which an AGT-associated disease or condition is present or likely to arise, non-limiting examples of which are the liver or kidneys. Direct tissue drug delivery can be achieved by direct injection or other means. Many orally delivered compounds naturally enter and pass through the liver and kidneys, and some embodiments of the treatment methods of the invention include orally administering to a subject one or more AGT dsRNA agents. AGT dsRNA agents or AGT antisense polynucleotide agents, either alone or in combination with other therapeutic agents, can be administered once, or they can be administered multiple times. If administered multiple times, the AGT dsRNA agent or AGT antisense polynucleotide agent may be administered by different routes. For example, although not intended to be limiting, the first (or first several) administrations may be administered subcutaneously, and one or more additional administrations may be oral and/or systemic.

For embodiments of the invention in which it is desired to administer the AGT dsRNA agent or AGT antisense polynucleotide agent systemically, the AGT dsRNA agent or AGT antisense polynucleotide agent may be formulated for parenteral administration by injection, for example, by bolus injection or continuous infusion. Injectable preparations may be presented in unit dosage form such as ampoules or multi-dose containers, with or without added preservatives. AGT dsRNA agent formulations (also known as pharmaceutical compositions) may take the form of suspensions, solutions or emulsions in oily or aqueous carriers, and may contain formulatory agents such as suspending, stabilizing and/or dispersing agents.

Formulations for parenteral administration include sterile aqueous or non-aqueous solutions, suspensions and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral carriers include sodium chloride solution, Ringer's dextrose solution, dextrose and sodium chloride solution, lactated Ringer's solution, or fixed oils. Intravenous excipients include fluid and nutritional supplements, electrolyte supplements (such as those based on Ringer's dextrose solution), and the like. Preservatives and other additives such as antimicrobials, antioxidants, chelating agents, inert gases, etc. may also be present. Other forms of administration, such as intravenous administration, will result in lower doses. If the subject's response at the initial dose is inadequate, a higher dose may be administered (or the dose may be effectively increased via a different, more localized delivery route) to the extent permitted by patient tolerance. Multiple doses per day can be used as needed to achieve appropriate systemic or local levels of one or more AGT dsRNA agents or AGT antisense polynucleotide agents and to achieve appropriate reductions in AGT protein activity.

In other embodiments, the methods of the present invention include the use of a delivery carrier, such as a biocompatible microparticle, nanoparticle, or implant suitable for implantation in a recipient, such as a subject. Exemplary biodegradable implants that may be used according to this method are described in PCT Publication WO 95/24929 (incorporated herein by reference), which describes a biocompatible, biodegradable matrix for containing a biological macromolecule.

Both non-biodegradable and biodegradable polymeric matrices can be used in the methods of the invention to deliver one or more AGT dsRNA agents or AGT antisense polynucleotide agents to a subject. In some embodiments, the matrix can be biodegradable. Matrix polymers can be natural or synthetic polymers. The polymer can be selected based on the period of time over which release is desired, typically on the order of a few hours to a year or more. Typically, releases over periods ranging from a few hours to three to twelve months are available. The polymer is optionally in the form of a hydrogel, which can absorb up to about 90% of its weight in water, and is optionally further cross-linked with multivalent ions or other polymers.

Typically, AGT dsRNA agents or AGT antisense polynucleotide agents may, in some embodiments of the invention, be delivered using biodegradable implants by diffusion or by degradation of the polymeric matrix. Exemplary synthetic polymers for this purpose are well known in the art. Biodegradable polymers and non-biodegradable polymers can be used to deliver AGT dsRNA agents or AGT antisense polynucleotide agents using methods known in the art. Bioadhesive polymers such as bioerodible hydrogels (H. S. Sawhney, C. P. Pathak and J. A. Hubell in *Macromolecules*, 1993, 26, 581-587) can also be used to deliver AGT dsRNA agents or AGT antisense polynucleotide agents for treating an AGT-associated disease or condition. Other suitable delivery systems may include timed release, delayed release, or sustained release delivery systems. Such systems may avoid repeated administration of AGT dsRNA agents or AGT antisense polynucleotide agents, thereby improving convenience to subjects and healthcare professionals. Many types of release delivery systems are available and known to those of ordinary skill in the art (see, for example, U.S. Pat. Nos. 5,075,109, 4,452,775, 4,675,189, 5,736,152, 3,854,480, 5,133,974, and 5,407,686). Additionally, pump-based hardware delivery systems are available, some of which are also suitable for implantation.

The use of long-term sustained release implants may be suitable for prophylactic treatment of subjects and for subjects at risk of developing recurrent AGT-associated diseases or conditions. As used herein, long-term release refers to implants constructed and arranged to deliver therapeutic levels of an AGT dsRNA agent or AGT antisense polynucleotide agent for at least up to 10 days, 20 days, 30 days, 60 days, 90 days, six months, one year, or longer. Long-term sustained release implants are well known to those of ordinary skill in the art and include some of the release systems described above.

Therapeutic formulation of AGT dsRNA agents or AGT antisense polynucleotide agents can be prepared and used for storage by mixing a molecule or compound having a desired purity with optional pharmaceutically acceptable carriers, excipients or stabilizers [Remington's Pharmaceutical Sciences 21st edition (2006)] in the form of a lyophilized formulation or an aqueous solution. Acceptable carriers, excipients or stabilizers are non-toxic to the recipient at the doses and concentrations employed, and include: buffers such as phosphates, citrates and other organic acids; antioxidants including ascorbic acid and methionine; preservatives (e.g. stearyldimethylbenzyl ammonium chloride, hexamethonium chloride, benzalkonium chloride, benzethonium chloride, phenol, butanol and benzyl alcohol, or parabens such as methyl or propylparaben, catechol, resorcinol, cyclohexanol, 3-pentanol, and m-cresol); low molecular weight (less than about 10 residues) peptides; proteins such as serum albumin, gelatin or immunoglobulins; hydrophilic polymers such as polyvinylpyrrolidone; amino acids such as glycine, glutamine, asparagine, histidine, arginine or lysine; monosaccharides, disaccharides and other carbohydrates, including glucose, mannose or dextrin; chelating agents such as EDTA; sugars such as sucrose, mannitol, trehalose or sorbitol; salt-forming counterions such as sodium; metal complexes (e.g. zinc-protein complexes); and/or non-ionic surfactants such as TWEEN®, PLURONICS® or polyethylene glycol (PEG).

Cells, Subjects and Controls

The methods of the invention can be used in conjunction with cells, tissues, organs and/or subjects. In some aspects of the invention, the subject is a human or vertebrate mammal, including but not limited to dogs, cats, horses, cattle, goats, mice, rats, and primates, such as monkeys. Accordingly, the present invention may be used to treat AGT-associated diseases or conditions in human and non-human subjects. In some aspects of the invention, the subject may be a farm animal, a zoo animal, a domesticated animal, or a non-domesticated animal, and the methods of the invention may be used in veterinary preventive and therapeutic regimens. In some embodiments of the invention, the subject is a human and the methods of the invention can be used in human prophylactic and therapeutic regimens.

Non-limiting examples of subjects to which the present invention may be applied are subjects diagnosed with, suspected of having, or at risk of suffering from a disease or condition associated with higher than desired AGT expression and/or activity, also referred to as "elevated AGT expression levels". Non-limiting examples of diseases and conditions associated with higher than desired levels of AGT expression and/or activity are described elsewhere herein. The methods of the present invention may be applied to subjects who, at the time of treatment, have been diagnosed as suffering from this disease or condition, subjects associated with higher than desired AGT expression and/or activity, or subjects considered to be at risk for diseases or conditions associated with higher than desired AGT expression and/or activity levels. In some aspects of the invention, the disease or condition associated with higher than desired levels of AGT expression and/or activity is an acute disease or condition; in certain aspects of the invention, the disease or condition associated with higher than desired levels of AGT expression and/or activity is a chronic disease or condition.

In a non-limiting example, the AGT dsRNA agent of the invention is administered to a patient diagnosed with hypertension, including essential hypertension, secondary hypertension, hypertensive emergencies (such as malignant hypertension and accelerated hypertension, acute hypertension, pregnancy-related hypertension, and resistant hypertension. The methods of the present invention may be applied to subjects who, at the time of treatment, have been diagnosed as having the disease or condition, or who are considered to be at risk of developing or developing the disease or condition.

In another non-limiting example, the AGT dsRNA agents of the invention are administered to treat a disease or disorder caused by or associated with activation of the renin-angiotensin-aldosterone system (RAAS), or a symptom or progression thereof in response to a disease or disorder in which the RAAS is inactivated. The term "angiotensinogen-related disease" includes diseases, disorders or conditions that benefit from reduced expression of AGT. Such diseases are typically associated with high blood pressure. Non-limiting examples of angiotensinogen-related diseases include hypertension, e.g., borderline hypertension (also known as prehypertension), essential hypertension (also known as essential hypertension or idiopathic hypertension), secondary hypertension (also called non-idiopathic hypertension), isolated systolic or diastolic hypertension, pregnancy-related hypertension (ego, preeclampsia, eclampsia, and postpartum preeclampsia), diabetic hypertension, resistant hypertension, refractory hypertension, paroxysmal hypertension, renovascular hypertension (also called renal hypertension), Goldblatt hypertension, ocular hypertension, glaucoma, pulmonary hypertension, portal hypertension, systemic venous hypertension, systolic hypertension, unstable hypertension, hypertensive heart disease, hypertensive nephropathy, atherosclerosis, arteriosclerosis, vascular disease (including peripheral vascular disease), diabetic nephropathy, diabetic retinopathy, chronic heart failure, cardiomyopathy, diabetic cardiomyopathy, glomerulosclerosis, aortic coarctation, aortic aneurysm, ventricular fibrosis, sleep apnea, heart failure (e.g., left ventricular systolic dysfunction), myocardial infarction, angina, stroke, renal disease (e.g., chronic kidney disease or diabetic nephropathy, optionally in the setting of pregnancy), renal failure (e.g., chronic renal failure), cognitive disorders (e.g. Alzheimer's disease) and systemic sclerosis (e.g., scleroderma renal crisis). In certain embodiments, AGT-associated disorders include intrauterine growth retardation (IUGR) or fetal growth restriction.

Cells to which the method of the present invention can be applied include cells that are in vitro, in vivo, and ex vivo cells. The cells may be in a subject, in culture and/or in suspension, or in any other suitable state or condition. The cells to which the method of the present invention can be applied may be: liver cells, hepatocytes, cardiac cells, pancreatic cells, cardiovascular cells, kidney cells or other types of vertebrate cells, including human and non-human mammalian cells. In certain aspects of the invention, cells to which the methods of the invention can be applied are healthy normal cells that are not known to be diseased cells. In certain embodiments of the invention, the methods and compositions of the invention are applied to cells of the liver, hepatocytes, heart cells, pancreatic cells, cardiovascular cells, and/or kidney cells. In certain aspects of the invention, control cells are normal cells, but it should be understood that cells having a disease or condition may also be used as control cells in certain circumstances, such as the case when comparing outcomes of treated cells having a disease or condition to untreated cells having a disease or condition.

According to the methods of the present invention, the level of AGT polypeptide activity can be determined and compared to a control level of AGT polypeptide activity. The control can be a predetermined value, which can take many forms. It can be a single cutoff value, such as the median or mean. It can be established based on comparing groups, for example in a group with normal levels of AGT polypeptide and/or AGT polypeptide activity and in a group with increased levels of AGT polypeptide and/or AGT polypeptide activity. Another non-limiting example of a comparison group may be a population with one or more symptoms or diagnosis of an AGT-associated disease or condition versus a population without one or more symptoms or diagnosis of the disease or condition, or a group of subjects to which the siRNA treatment of the invention was administered versus a group of subjects to which the siRNA treatment of the invention was not administered. Typically, controls can be based on apparently healthy normal individuals or apparently healthy cells in an appropriate age group. It should be understood that, in addition to predetermined values, a control according to the present invention may be a sample of material tested in parallel with the experimental material. Examples include samples from control populations or control samples produced by manufacturing for testing in parallel with experimental samples. In some embodiments of the invention, controls may include cells or subjects that have not been exposed to or treated with an AGT dsRNA agent of the invention, in which case the control levels of AGT polypeptides and/or AGT polypeptide activity may be compared to levels of AGT polypeptide and/or AGT polypeptide activity in a cell or subject exposed to an AGT dsRNA agent or AGT antisense polynucleotide agent of the invention.

In some embodiments of the invention, the control level may be an AGT polypeptide level determined for a subject to which AGT polypeptide levels determined for the same subject at different times are compared. In one non-limiting example, levels of AGT are determined in biological samples obtained from subjects who have not received AGT treatment of the present invention. In some embodiments, the biological sample is a serum sample. The AGT polypeptide level determined in a sample obtained from a subject may serve as a baseline or control value for the subject. After one or more administrations of an AGT dsRNA agent to a subject in a treatment method of the invention, one or more additional serum samples can be obtained from the subject, and the AGT polypeptide levels in the subsequent one or more samples can be compared to the subject's control/baseline levels. Such comparisons can be used to assess the onset, progression, or regression of an AGT-associated disease or condition in a subject. For example, a level of AGT polypeptide in a baseline sample obtained from a subject that is greater than the level obtained from the same subject after administration of an AGT dsRNA agent or an AGT antisense polynucleotide agent of the invention to the subject is indicative of regression of the AGT-associated disease or condition and indicates the efficacy of administered AGT dsRNA agents of the invention in treating AGT-associated diseases or conditions.

In certain aspects of the invention, one or more of the AGT polypeptide and/or AGT polypeptide activity levels determined for a subject can serve as a control value for later comparison of AGT polypeptide and/or AGT activity levels in the same subject, thereby allowing assessment of changes from a "baseline" AGT polypeptide activity in a subject. Therefore, where the initial level is used as a control level for the subject, the initial AGT polypeptide level and/or the initial AGT polypeptide activity level may be used to indicate and/or determine the ability of the methods and compounds of the invention to reduce the level of AGT polypeptide and/or AGT polypeptide activity in that subject.

Using the methods of the invention, an AGT dsRNA agent and/or AGT antisense polynucleotide agent of the invention can be administered to a subject. Such dsRNAi agents include, for example, duplexes AD00051 to AD00122-19-2, AD00163-3, AV01227 to AVAV01257, and AV01711 shown in Table 1. In some embodiments, preferred dsRNAi agents include, for example, duplexes AD00158, AD00163, AD00163-3.AD00159, AD00290, AD00300 or AD00122. In other embodiments, preferred dsRNAi agents include, for example, AD00158-1, AD00158-2, AD00163-1, AD00159-1, or AD00300-1. In some other embodiments, such dsRNAi agents include duplex variants, e.g. variants of duplexes AD00158, AD00163, AD00163-3, AD00159, AD00290, AD00300 or AD00122. The efficacy of administration and treatment of the invention can be assessed as compared to pre-dose levels of AGT polypeptide in serum samples obtained from the subject at previous time points, or to non-exposure control levels (e.g., the level of AGT polypeptide in a control serum sample). When administered and treated, the level of the AGT polypeptide in a serum sample obtained from the subject is reduced by at least 0.5%, 1%, 5%, 10%, 20%, 30%, 40%, 50%, 60%, 70%, 80%, 90%, 95% or more. It should be understood that both the level of AGT polypeptide and the level of AGT polypeptide activity are related to the level of AGT gene expression. Certain embodiments of the methods of the invention include administering to a subject an AGT dsRNA and/or AGT antisense agent of the invention in an amount effective to inhibit AGT gene expression, thereby reducing the level of AGT polypeptide and reducing the level of AGT polypeptide activity in the subject.

Some embodiments of the invention include determining the presence, absence, and/or amount (also referred to herein as level) of an AGT polypeptide in one or more biological samples obtained from one or more subjects. This determination can be used to assess the efficacy of the treatment methods of the invention. For example, the methods and compositions of the invention can be used to determine a level of an AGT polypeptide in biological samples obtained from subjects previously treated with administration of an AGT dsRNA agent and/or AGT antisense agent of the invention. A reduction in the level of AGT polypeptide in a serum sample after administration and treatment by at least 0.5%, 1%, 5%, 10%, 20%, 30%, 40%, 50%, 60%, 70%, 80%, 90%, 95% or more compared to a pre-administration level of AGT polypeptide in serum samples obtained from the subject at a previous time point, or compared to a non-exposure control level (e.g., an AGT polypeptide level in a control serum sample) indicates the level of efficacy of the treatment given to the subject.

In some embodiments of the present invention, the physiological characteristics of an AGT-associated disease or condition determined for the subject can be used as a control result, and the determination of the physiological characteristics of the same subject at different times are compared with the control results. In one non-limiting example, blood pressure (and/or other physiological characteristics of an AGT disease or condition) is measured from a subject who has never been administered an AGT treatment of the present invention, which can be used as a baseline or control value for the subject. After one or more administrations of an AGT dsRNA agent to the subject in a treatment method of the invention, blood pressure is measured and compared to the subject's control/baseline levels, respectively. Such comparisons can be used to assess the onset, progression, or regression of an AGT-associated disease or condition in a subject. For example, a baseline blood pressure obtained from a subject that is higher than the blood pressure measured from the same subject after administration of an AGT dsRNA agent or AGT antisense polynucleotide agent of the invention to the subject is indicative of regression of the AGT-associated disease or disorder, and attests to the efficacy of administering the AGT dsRNA agent of the invention in treating AGT-associated diseases or conditions.

In some aspects of the invention, the value determined for a subject for one or more physiological characteristics of an AGT-associated disease or disorder may serve as a control value for later comparison of physiological characteristics of the same subject, thereby allowing assessment of changes in the "baseline" physiological characteristics of the subject. Thus, it is possible to obtain an initial physiological profile in an individual, measure the initial physiological profile measured as a control for that subject, and show and/or determine the effect of using the methods and compounds of the invention to reduce the level of AGT polypeptide and/or the activity of the AGT polypeptide in the individual. Using the methods of the invention, the AGT dsRNA agents and/or AGT antisense polynucleotide agents of the invention can be administered to a subject in an amount effective to treat an AGT disease or condition. The efficacy of administration and treatment of the present invention can be assessed by determining changes in one or more physiological characteristics of the AGT disease or condition. In one non-limiting example, a subject's blood pressure is reduced, as compared to blood pressure obtained from the subject at a previous time point, or when compared to a non-exposed control blood pressure, by at least 0.5 mmHg, 1 mmHg, 2 mmHg, 3 mmHg, 4 mmHg, 5 mmHg, 6 mmHg, 7 mmHg, 8 mmHg, 9 mmHg, mmHg, 11 mmHg, 12 mmHg, 13 mmHg, 14 mmHg, 15 mmHg, 16 mmHg, 17 mmHg, 18 mmHg, 19 mmHg, 20 mmHg or more until the subject blood pressure is within the normal range.

Some embodiments of the invention include determining the presence, absence, and/or changes in physiological characteristics of an AGT-associated disease or condition using methods such as, but not limited to: (1) measuring the subject's blood pressure; (2) assessing a physiological characteristic of one or more biological samples obtained from one or more subjects; (3) or physical examination of the subject. This determination can be used to assess the efficacy of the treatment methods of the invention.

Kits

Kits containing one or more AGT dsRNA agents and/or AGT antisense polynucleotide agents and instructions for their use in the methods of the invention are also within the scope of the invention. Kits of the invention may include one or more of an AGT dsRNA agent, an AGT sense polynucleotide, and an AGT antisense polynucleotide agent useful in treating an AGT-associated disease or condition. Kits containing one or more AGT dsRNA agents, AGT sense polynucleotides, and AGT antisense polynucleotide agents can be prepared for use in the treatment methods of the invention. Components of kits of the invention may be packaged in an aqueous medium or in lyophilized form. A kit of the invention may comprise a carrier divided to enclose therein one or more container means or a series of container means (such as test tubes, vials, flasks, bottles, syringes, and the like). A first container means or series of container means may contain one or more compounds, such as an AGT dsRNA agent and/or an AGT sense or antisense polynucleotide agent. A second container means or series of container means may contain targeting agents, labeling agents, or delivery agents, etc., which may be included therein as a portion of the AGT dsRNA and/or AGT antisense polynucleotides to be administered in embodiments of a treatment method of the invention.

A kit of the present invention may also comprise instructions. Instructions are usually in written form and will provide guidance for performing the treatment embodied by the kit and for making decisions based upon that treatment.

The following examples are provided to illustrate specific instances of the practice of the invention and are not intended to limit the scope of the invention. It will be apparent to one of ordinary skill in the art that the present invention is applicable to a variety of compositions and methods.

EXAMPLES

Example 1. Synthesis of RNAi Agents

The AGT RNAi agent duplexes shown in Table 2-4 above were synthesized according to the following general procedure:

siRNA sense and antisense strand sequences were synthesized on an oligonucleotide synthesizer using a well-established solid-phase synthesis method based on phosphoramidite chemistry. Oligonucleotide chain propagation was achieved by means of a 4-step cycle: a deprotection, a condensation, a capping, and an oxidation or sulfurization step for addition of each nucleotide. Syntheses were performed on a solid support made of controlled pore glass (CPG, 1000 Å). Monomer phosphoramidites were purchased from commercial sources. Phosphoramidites with GalNAc ligand clusters (GLPA1 and GLPA2 as non-limiting examples) were synthesized according to the procedures of Examples 2-3 herein. For siRNAs used for in vitro screening (Table 2), synthesis was performed at a 2 µmol scale; for siRNA for in vivo testing (Tables 3, 4), syntheses were conducted at a scale of 5 µmol or larger. In the case where a GalNAc ligand (GLO-0 as a non-limiting example) is attached to the 3'-end of the sense strand, a CPG solid support to which the GalNAc ligand is attached was used. In the case where a GalNAc ligand (GLS-1 or GLS-2 as a non-limiting example) is attached to the 5'-end of the sense strand, a GalNAc phosphoramidite (GLPA1 or GLPA2 as a non-limiting example) was used for the final coupling reaction. Trichloroacetic acid (TCA) in 3% dichloromethane was used for deprotection of the 4,4'-dimethoxytrityl protecting group (DMT). 5-Ethylthio-1H-tetrazole was used as activator. 12 in THF/Py/$H_2O$ and phenylacetyl disulfide (PADS) in pyridine/MeCN were used for oxidation and sulfurization reactions, respectively. After the final solid-phase synthesis step, the solid support-bound oligomers were cleaved and protecting groups were removed by treatment with a 1:1 volume of 40 wt % aqueous methylamine and 28% ammonium hydroxide solution. To synthesize siRNAs for in vitro screening, the crude mixture was concentrated. The remaining solid was dissolved in 1.0 M NaOAc and ice-cold EtOH was added to precipitate the single-strand product as the sodium salt, which was used for annealing without further purification. To synthesize siRNAs for in vivo testing, the crude single-stranded product was further purified by ion pairing reversed-phase HPLC (IP-RP-HPLC). The purified single-stranded oligonucleotide product from IP-RP-HPLC was converted to the sodium salt by dissolving in 1.0 M NaOAc and precipitating by the addition of ice-cold EtOH. The sense and antisense strand oligonucleotides were annealed by equimolar complementation in water to form a double-stranded siRNA product, which was lyophilized to yield a fluffy white solid.

Example 2. Preparation of Intermediate-A and Intermediate-B

Intermediate-A was synthesized by treating commercially available galactosamine pentaacetate with trimethylsilyl trifluoromethanesulfonate (TMSOTf) in dichloromethane (DCM) as shown in Scheme 1 below. This was followed by glycosylation with Cbz-protected 2-(2-aminoethoxy) ethan-1-ol to give compound II. The Cbz protecting group was removed by hydrogenation to yield Intermediate-A as the trifluoroacetate (TFA) salt. Intermediate B was synthesized based on the same scheme except that Cbz protected 2-(2-(2-aminoethoxy) ethoxy) ethan-1-ol served as the starting material.

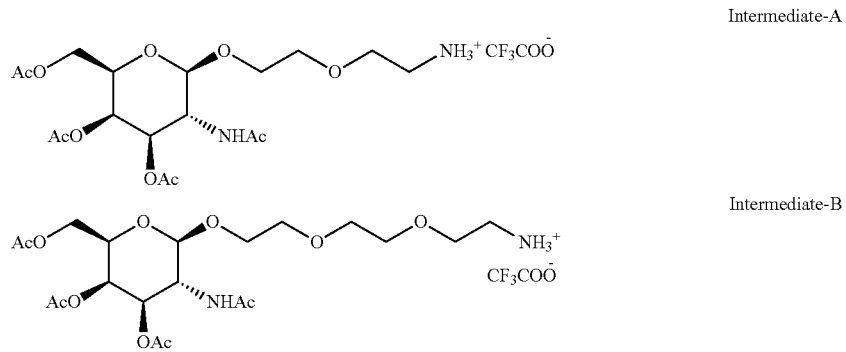

Intermediate-A

Intermediate-B

Scheme 1

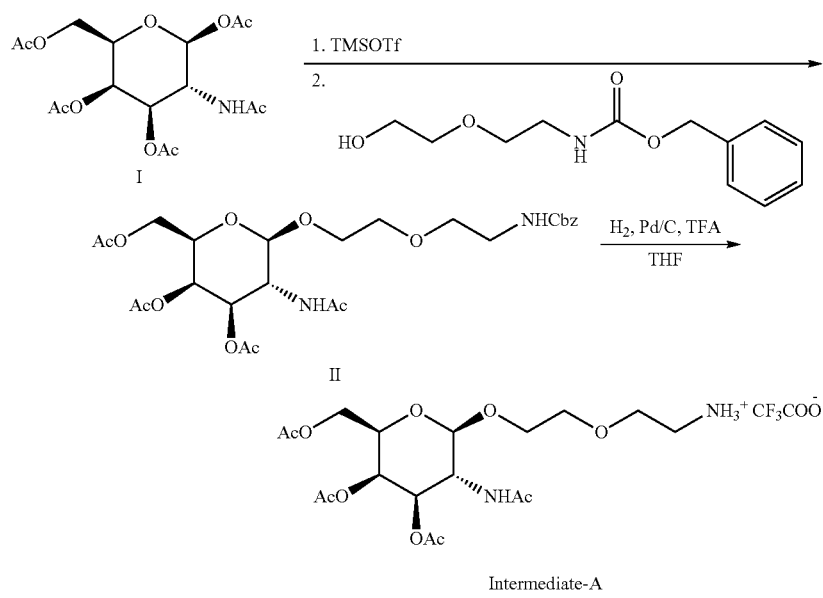

Intermediate-A

To a solution of compound I (20.0 g, 51.4 mmol) in 100 mL 1,2-dichloroethane (DCE) was added TMSOTf (17.1 g, 77.2 mmol). The resulting reaction solution was stirred at 60° C. for 2 h and then at 25° C. for 1 h. Cbz-protected 2-(2-aminoethoxy) ethan-1-ol (13.5 g, 56.5 mmol) was dissolved in DCE (100 mL), dried over 4 Å powdered molecular sieves (10 g), and added dropwise to the above reaction solution at 0° C. under $N_2$ atmosphere. The resulting reaction mixture was stirred at 25° C. for 16 hours under $N_2$ atmosphere. The reaction mixture was filtered and washed with saturated $NaHCO_3$ (200 mL), water (200 mL) and saturated brine (200 mL). The organic layer was dried over anhydrous $Na_2SO_4$, filtered and concentrated under reduced pressure to give a crude product, which was triturated with 2-methyltetrahydrofuran/heptane (5/3, v/v, 1.80 L) for 2 hours. The resulting mixture was filtered and dried to obtain compound II as a white solid (15.0 g, yield 50.3%).

10% Pd/C (1.50 g) was carefully added to a dry and argon-purged hydrogenation flask, followed by 10 mL of tetrahydrofuran (THF), and then a solution of compound II (15.0 g, 26.4 mmol) in THF (300 ml) and TFA (trifluoroacetic acid, 3.00 g, 26.4 mmol). The resulting mixture was degassed and purged three times with $H_2$ and stirred at 25° C. for 3 h under an $H_2$ (45 psi) atmosphere. Thin layer chromatography (TLC, solvent: DCM:MeOH=10:1) indicated complete consumption of Compound II. The reaction mixture was filtered and concentrated under reduced pressure. The residue was dissolved in anhydrous DCM (500 mL) and concentrated. This process was repeated three times to obtain Intermediate-A as a foamy white solid (14.0 g, yield 96.5%). $^1H$ NMR (400 MHz DMSO-$d_6$): δ ppm 7.90 (d, J=9.29 Hz, 1H), 7.78 (br s, 3H), 5.23 (d, J=3.26 Hz, 1H), 4.98 (dd, J=11.29, 3.26 Hz, 1H), 4.56 (d, J=8.53 Hz, 1H), 3.98-4.07 (m, 3H), 3.79-3.93 (m, 2H), 3.55-3.66 (m, 5H), 2.98 (br d, J=4.77 Hz, 2H), 2.11 (s, 3H), 2.00 (s, 3H), 1.90 (s, 3H), 1.76 (s, 3H).

Intermediate-B was synthesized using a similar procedure to the synthesis of Intermediate-A. $^1H$ NMR (400 MHZ DMSO-$d_6$): δ ppm 7.90 (br d, J=9.03 Hz, 4H), 5.21 (d, J=3.51 Hz, 1H), 4.97 (dd, J=11.1 Hz, 1H), 4.54 (d, J=8.53 Hz, 1H), 3.98-4.06 (m, 3H), 3.88 (dt, J=10.9 Hz, 1H), 3.76-3.83 (m, 1H), 3.49-3.61 (m, 9H), 2.97 (br s, 2H), 2.10 (s, 3H), 1.99 (s, 3H), 1.88 (s, 3H), 1.78 (s, 3H). Mass calc. for $C_{20}H_{34}N_2O_{11}$: 478.22; found: 479.3 (M+H$^+$).

Example 3. Synthesis of GalNAc Ligand Cluster Phosphoramidites GLPA1, GLPA2 and GLPA15

GLPA1 and GLPA2 were prepared according to Scheme 2 below. Starting from benzyl-protected propane-1,3-diamine, alkylation with tert-butyl 2-bromoacetate afforded triester Compound I. Removal of the benzyl protecting group by hydrogenation afforded secondary amine Compound II. Coupling of the amide with 6-hydroxycaproic acid afforded Compound III. The tert-butyl protecting group was then removed upon treatment with HCl in dioxane to yield triacid Compound IV. Amide coupling between triacid compound IV and Intermediate-A or Intermediate-B was performed to afford Compound Va or Vb. Phosphoramidites GLPA1 or GLPA2 were synthesized by phosphorylation of Compounds Va or Vb with 2-cyanoethyl N,N-diisopropylchloridephosphoramidite and a catalytic amount of 1H-tetrazole.

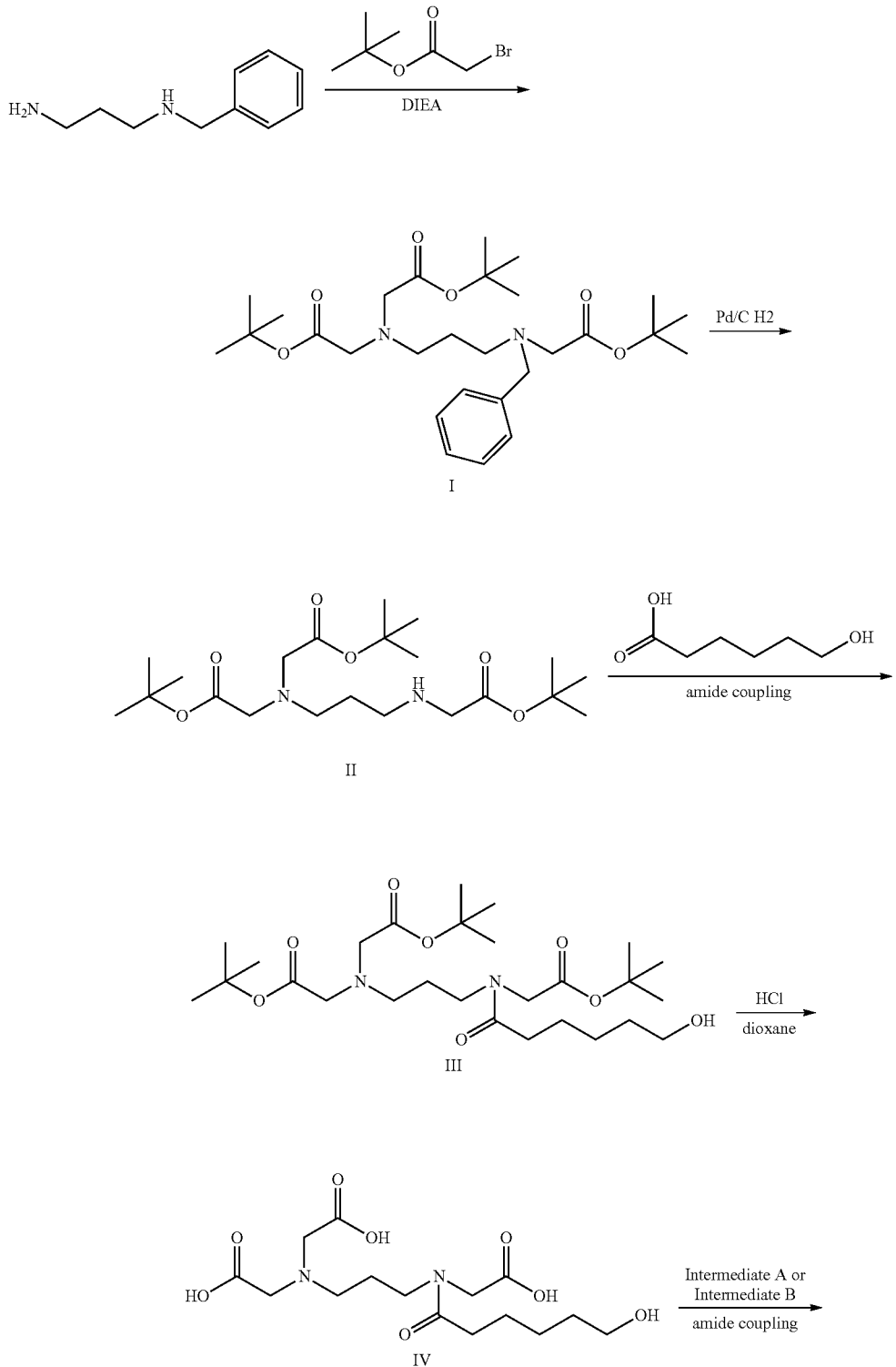

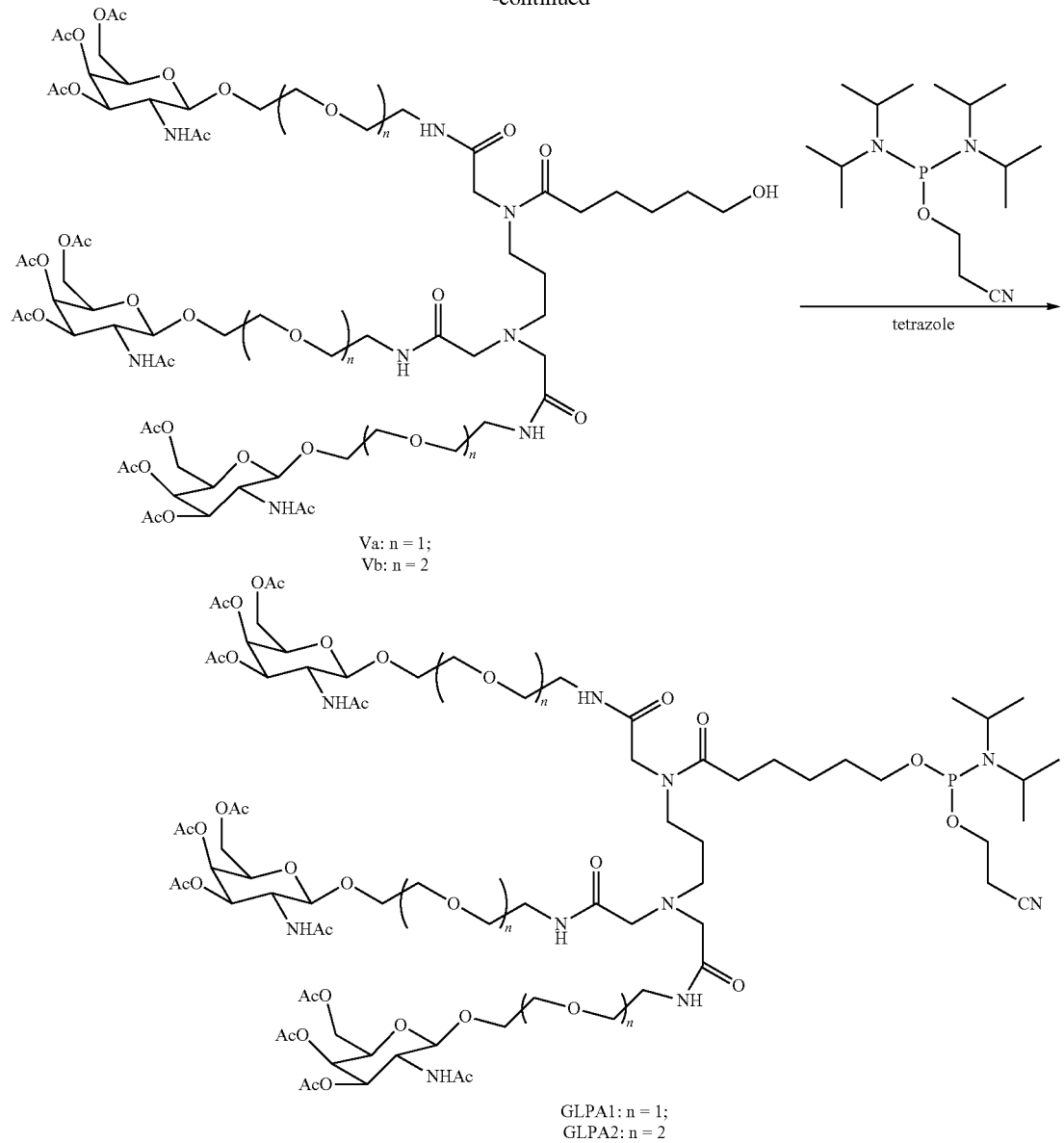

Va: n = 1;
Vb: n = 2

GLPA1: n = 1;
GLPA2: n = 2

N-benzyl-1,3-propanediamine (5.00 g, 30.4 mmol) in dimethylformamide (DMF, 100 mL) was added ter-butyl 2-bromoacetate (23.7 g, 121 mmol), followed by the addition of diisopropylethylamine (DIEA, 23.61 g, 182 mmol) dropwise. The resulting reaction mixture was stirred at 25-30° C. for 16 hours. LCMS showed complete consumption of N-benzyl-1,3-propanediamine. The reaction mixture was diluted with H₂O (500 mL) and extracted with EtOAc (500 mL×2). The combined organics were washed with saturated brine (1L), dried over anhydrous Na₂SO₄, filtered, and concentrated under reduced pressure to obtain a crude product, which was purified by silica gel column chromatography (gradient: petroleum ether:ethyl acetate 20:1 to 5:1). Compound I was obtained as a colorless oil (12.1 g, yield 78.4%). ¹H NMR (400 MHZ, CDCl₃): δ ppm 7.26-7.40 (m, 5H), 3.79 (s, 2H), 3.43 (s, 4H), 3.21 (s, 2H), 2.72 (dt, J=16.9, 7.34 Hz, 4H), 1.70 (quin, J=7.2 Hz, 2H), 1.44-1.50 (m, 27H).

A dried hydrogenation bottle was purged three times with argon. Pd/C (200 mg, 10%) was added, followed by MeOH (5 mL), then compound I (1.00 g, 1.97 mmol) in MeOH (5 mL). The reaction mixture was degassed under vacuum and refilled with H₂. This process was repeated three times. The mixture was stirred at 25° C. for 12 hours under an H₂ atmosphere (15 psi). LCMS showed that Compound I was completely consumed. The reaction mixture was filtered under reduced pressure under an N₂ atmosphere. The filtrate was concentrated under reduced pressure to yield Compound II (655 mg, yield 79.7%) as a yellow oil, which was used in the next step without further purification. ¹H NMR (400 MHZ, CDCl₃): δ ppm 3.44 (s, 4H), 3.31 (s, 2H), 2.78 (t, J=7.1 Hz, 2H), 2.68 (t, J=6.9 Hz, 2H), 1.88 (br s, 1H), 1.69 (quin, J=7.03 Hz, 2H), 1.44-1.50 (s, 27H).

A mixture of Compound II (655 mg, 1.57 mmol), 6-hydroxycaproic acid (249 mg, 1.89 mmol), DIEA (1.02 g, 7.86 mmol), 1-ethyl-3-(3-dimethylaminopropyl) carbodiimide hydrochloride (EDCI, 904 mg, 4.72 mmol) and 1-hydroxybenzotriazole (HOBt, 637 mg, 4.72 mmol) in DMF (6 mL) was degassed and purged three times with N₂, then stirred under an N₂ atmosphere at 25° C. for 3 hours. LCMS indicated the desired product. The reaction mixture was diluted with H₂O (10 mL) and extracted with EtOAc 20 mL (10 mL×2). The organics were combined and washed with saturated brine (20 mL), dried over anhydrous Na₂SO₄, and filtered and concentrated to obtain the crude product, which was purified by silica gel column chromatography (gradient: petroleum ether:ethyl acetate from 5:1 to 1:1) to give Compound III (650 mg, yield 77.8%) as a yellow oil. ¹H NMR (400 MHz, CDCl₃): δ ppm 3.90-3.95 (s, 2H), 3.63 (t, J=6.40 Hz, 2H), 3.38-3.45 (m, 6H), 2.72 (t, J=6.65 Hz, 2H), 2.40 (t, J=7.28 Hz, 2H), 1.55-1.75 (m, 8H), 1.44 (s, 27H). Mass calc. for C₂₇H₅₀N₂O₈: 530.36; found: 531.3 (M+H⁺).

A mixture of Compound III (5.5 g, 10.3 mmol) in HCl/dioxane (2M, 55 mL) was stirred at 25° C. for 3 h. LCMS showed complete consumption of Compound III. The reaction mixture was filtered, washed with EtOAc (50 mL), and dried under reduced pressure to obtain a crude product. This was dissolved in CH₃CN (50 mL) and volatiles removed under vacuum. This process was repeated three times to obtain Compound IV as a white solid (2.05 g, yield 54.5%). ¹H NMR (400 MHz, D₂O): δ ppm 4.21 (s, 1H), 4.07 (d, J=4.5 Hz, 4H), 3.99 (s, 1H), 3.45-3.52 (m, 3H), 3.42 (t, J=6.5 Hz, 1H), 3.32-3.38 (m, 1H), 3.24-3.31 (m, 1H), 2.37 (t, J=7.4 Hz, 1H), 2.24 (t, J=7.4 Hz, 1H), 1.99 (dt, J=15.5, 7.53 Hz, 1H), 1.85-1.94 (m, 1H), 1.85-1.94 (m, 1H), 1.39-1.56 (m, 4H), 1.19-1.31 (m, 2H).

A mixture of Compound IV (500 mg, 1.05 mmol), Intermediate-A (2.02 g, 3.67 mmol), DIEA (813 mg, 6.30 mmol), EDCI (704 mg, 3.67 mmol) and HOBt in DMF (10 mL) (496 mg, 3.67 mmol) was degassed and purged three times with N₂, before stirring the mixture at 25° C. under an N₂ atmosphere for 3 h. LCMS indicated the desired product. The reaction mixture was quenched by adding H₂O (10 mL), and extracted with DCM (10 mL×2). The combined organics were extracted with 10% citric acid (20 mL). The aqueous phase was neutralized with saturated NaHCO₃ solution and re-extracted with DCM (10 mL×2). The organics were dried over sodium sulfate, filtered and concentrated under reduced pressure to give Compound Va as a white solid (570 mg, 0.281 mmol, 26.8% yield). ¹H NMR: (400 MHZ, CDCl₃) ppm δ 7.84-8.12 (m, 3H), 6.85-7.15 (m, 2H), 6.66-6.81 (m, 1H), 5.36 (br d, J=2.7 Hz, 3H), 5.11-5.27 (m, 3H), 4.63-4.85 (m, 3H), 3.90-4.25 (m, 18H), 3.37-3.75 (m, 28H), 3.15-3.28 (m, 4H), 2.64 (br d, J=6.53 Hz, 2H), 2.30-2.46 (m, 2H), 2.13-2.18 (m, 9H), 2.05 (s, 9H), 1.94-2.03 (m, 18H), 1.68 (br s, 2H), 1.45 (br s, 2H), 1.12 (br t, J=7.0 Hz, 2H).

To a solution of Compound Va (260 mg, 0.161 mmol) in anhydrous DCM (5 mL) was added diisopropylammonium tetrazolide (30.3 mg, 0.177 mmol) followed by 3-bis(diisopropylamino)phosphanyloxypropanenitrile (194 mg, 0.645 mmol) added dropwise at ambient temperature under N₂. The reaction mixture was stirred at 20 to 25° C. for 2 hours. LCMS showed that compound Va was completely consumed. After cooling to −20° C., the reaction mixture was added to a stirred solution of brine/saturated NaHCO₃ (1:1, 5 mL) at 0° C. After stirring for 1 minute, DCM (5 mL) was added, and stratification occurred. The organic layer was washed with brine/saturated aqueous NaHCO₃ solution (1:1, 5 mL), dried over Na₂SO₄, filtered and concentrated to a volume of approximately 1 mL. The remaining solution was added dropwise to 20 mL of methyl tert-butyl ether (MTBE) while stirring. This resulted in the precipitation of a white solid. The mixture was centrifuged and the solid was collected. The solid was redissolved in 1 mL DCM and precipitated by adding MTBE (20 mL). The solid was isolated again by centrifugation. The collected solid was dissolved in anhydrous CH₃CN, and the volatiles removed. This process was repeated two more times to yield the GalNAc ligand phosphoramidite compound GLPA1 (153 mg, 84.4 μmol) as a white solid. ¹H NMR (400 MHZ, CDCl₃): ppm δ 7.71-8.06 (m, 2H), 6.60-7.06 (m, 3H), 5.37 (br d, J=3.0 Hz, 3H), 5.18-5.32 (m, 3H), 4.70-4.86 (m, 3H), 3.92-4.25 (m, 18H), 3.42-3.85 (m, 30H), 3.25 (m, 4H), 2.59-2.75 (m, 4H), 2.27-2.44 (m, 2H), 2.15-2.20 (s, 9H) 2.07 (s, 9H), 1.96-2.03 (m, 18H), 1.65 (br s, 4H), 1.44 (br d, J=7.28 Hz, 2H), 1.14-1.24 (m, 12H). ³¹P NMR (CDCl₃): ppm δ 147.15.

The GalNAc ligand phosphoramidite compound GLPA2 was synthesized using the same procedure except that Intermediate-B was used. ¹H NMR (400 MHZ, CDCl₃): ppm δ 7.94-8.18 (m, 1H), 7.69 (br s, 1H), 6.66-7.10 (m, 3H), 5.35 (d, J=3.5 Hz, 3H), 5.07-5.25 (m, 3H), 4.76-4.86 (m, 3H), 4.01-4.31 (m, 10H), 3.91-4.01 (m, 8H), 3.74-3.86 (m, 4H), 3.52-3.71 (m, 30H), 3.42-3.50 (m, 6H), 3.15-3.25 (m, 4H), 2.52-2.70 (m, 4H), 2.22-2.45 (m, 2H), 2.15-2.22 (s, 9H), 2.06 (s, 9H), 1.95-2.03 (m, 18H), 1.77 (br s, 2H), 1.58-1.66 (m, 4H), 1.40 (m, 2H), 1.08-1.24 (m, 12H). ³¹P NMR (CDCl₃): ppm δ 147.12.

Scheme 3 below was followed to prepare GLPA15.

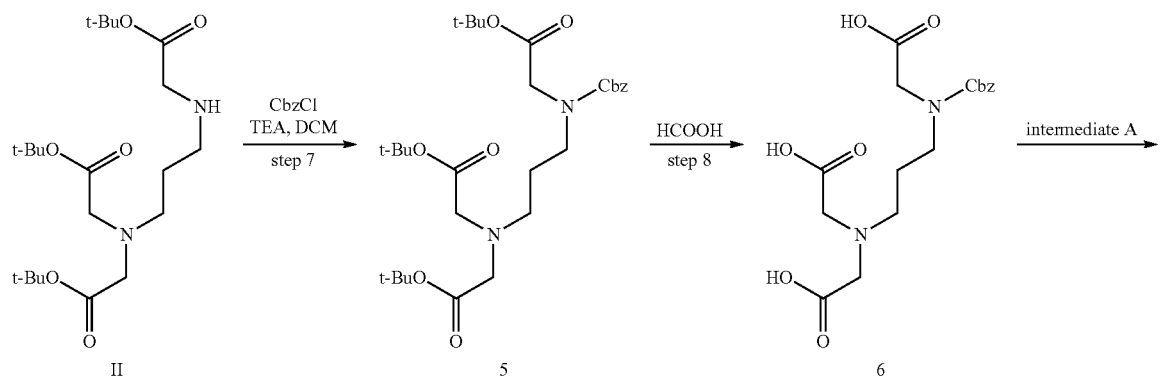

-continued
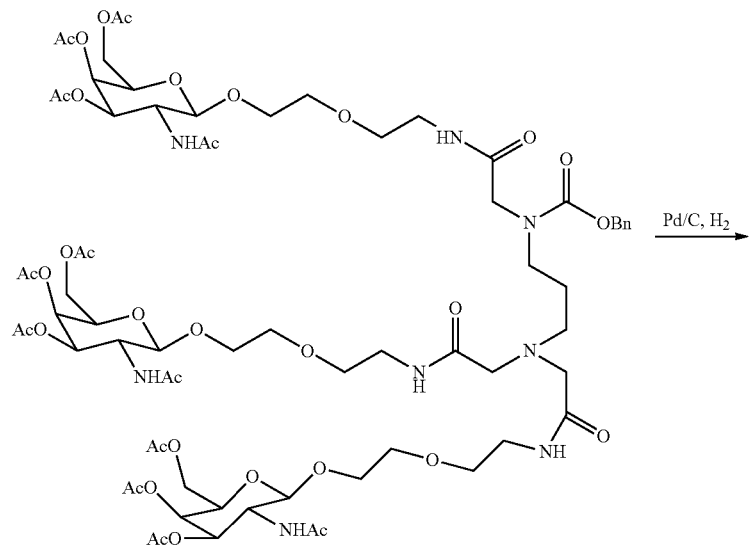
8
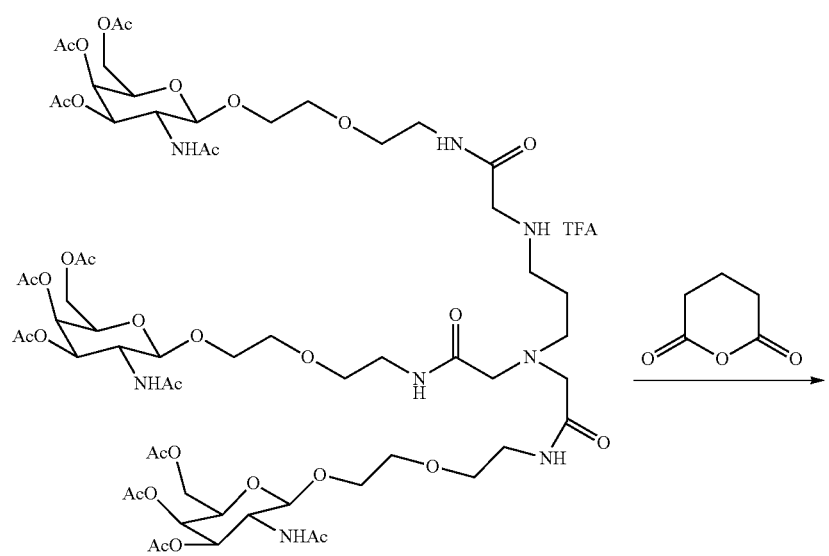
9

-continued
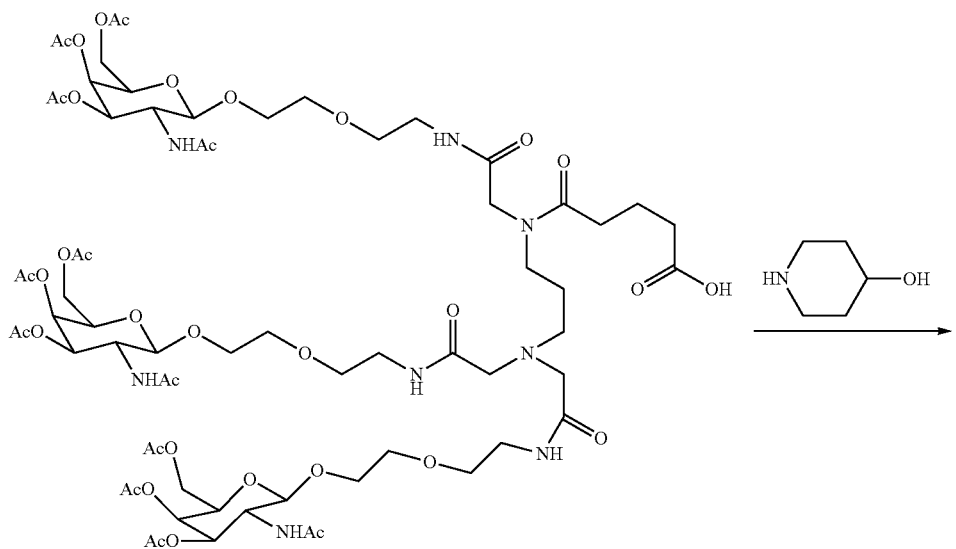
11
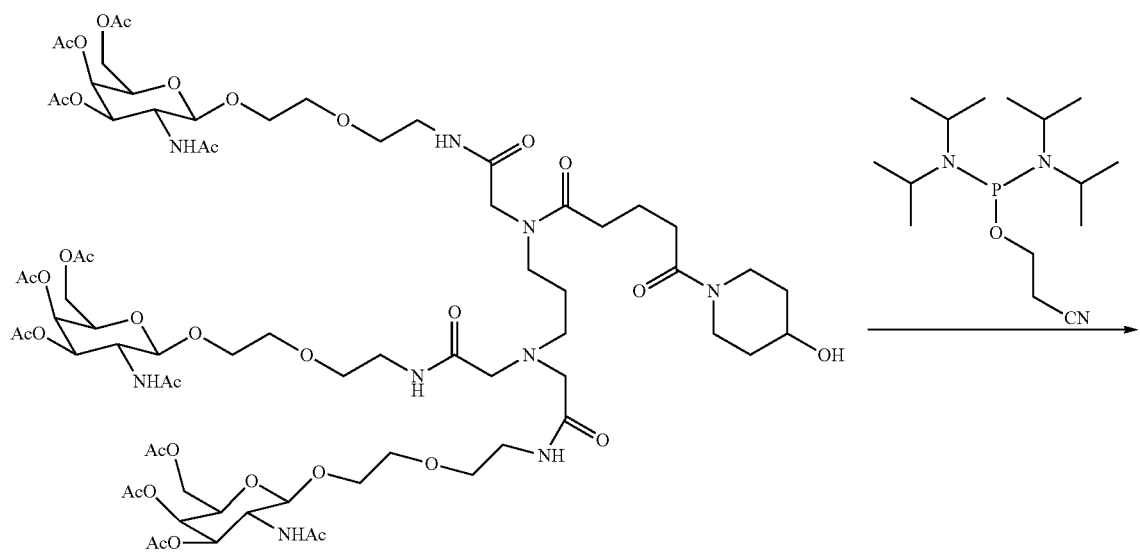
13

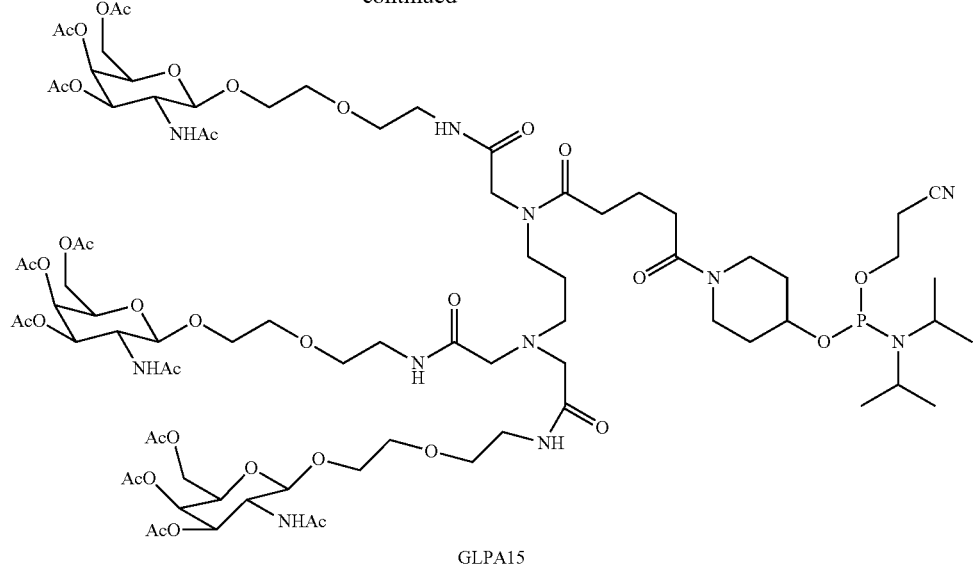

GLPA15

To a solution of intermediate compound II (275 g, 660 mmol, 1.00 eq.) in dichloromethane (2.75 L) was added triethylamine (133 g, 1.32 mol, 2.00 eq.), followed by the dropwise addition of Cbz-Cl (169 g, 990 mmol, 1.50 eq.). The reaction solution was stirred at 25° C. for 2 hours, whereupon LCMS showed that Compound II was completely converted. The reaction solution was washed with saturated NaHCO$_3$ (800 mL) solution and saturated brine (500 mL) in sequence, and the organic phase was dried over anhydrous Na$_2$SO$_4$. After filtering to remove the desiccant, the filtrate was concentrated to dryness. The crude product was subjected to column chromatography (SiO$_2$, PE/EA=100/1 to 5/1) to obtain Compound 5 as a colorless oil (290 g, 527 mmol, yield 75.7%). $^1$H NMR (400 MHz in DMSO-d$_6$): δ ppm 7.23-7.40 (m, 5H), 5.00-5.12 (m, 2H), 3.86-3.95 (m, 2H), 3.23-3.39 (m, 6H), 2.55-2.67 (m, 2H), 1.56-1.64 (m, 2H), 1.31-1.46 (m, 27H). MS (ESI) [M+H]$^+$ m/z: 551.6.

To Compound 5 (145 g, 263 mmol, 1.00 eq.) was added HCOOH (2.9 L), and the solution was stirred at 60° C. for 12 h, whereupon LCMS showed complete conversion of Compound 5. 1.5 L of toluene and 1.5 L acetonitrile were added to the reaction solution, which was concentrated under reduced pressure to about 500 mL. Toluene/acetonitrile (1:1, about 750 mL) was then added, before concentrating to about 500 mL. This was followed by the addition of acetonitrile (about 1000 mL), before concentrating to dryness. The crude product was pulverized with 700 mL of acetonitrile at 60° C. for 2 hours and then filtered. The solid was collected and dried to obtain a white solid, Compound 6 (105 g, quantitative). $^1$H NMR (400 MHz in DMSO-d$_6$): δ ppm 7.26-7.40 (m, 5H), 5.02-5.10 (m, 2H), 3.89-4.00 (m, 2H), 3.36-3.45 (m, 4H), 3.24-3.34 (m, 2H), 2.59-2.72 (m, 2H), 1.40 (s, 2H). MS (ESI) [M+H]$^+$ m/z: 383.0.

To a DMF (1.0 L) solution of Compound 6 (100 g, 261 mmol) and Intermediate-A (502 g, 915. mmol, 3.50 eq.) was added TBTU (327 g, 1.02 mol, 3.90 eq.) and triethylamine (212 g, 2.09 mol, 8.00 eq.). The reaction was carried out at 25° C. for 1 hour, whereupon LCMS showed complete conversion of Compound 6. The reaction solution was added to 4000 mL of water, and extracted with methyl tert-butyl ether (2000 mL twice) to remove impurities. The remaining aqueous phase was extracted with dichloromethane (3000 mL twice). The dichloromethane phase was washed successively with 10% citric acid aqueous solution (2000 mL split over two washes), saturated NaHCO$_3$ (2.0 L split over two washes), and saturated brine (2.0 L), then dried over anhydrous Na$_2$SO$_4$. The filtrate was filtered and concentrated under reduced pressure to yield a white solid, Compound 8 (260 g, 159 mmol, yield 60.9%). $^1$H NMR (400 MHz in DMSO-d$_6$): δ ppm 7.99-8.08 (m, 2H), 7.93 (br d, J=5.50 Hz, 1H), 7.79-7.86 (m, 3H), 7.26-7.39 (m, 5H), 5.22 (d, J=3.13 Hz, 3H), 4.95-5.08 (m, 5H), 4.54 (br d, J=8.38 Hz, 3H), 4.03 (s, 9H), 3.81-3.93 (m, 5H), 3.76 (br d, J=4.88 Hz, 3H), 3.44-3.62 (m, 10H), 3.34-3.43 (m, 6H), 3.24 (br d, J=6.13 Hz, 7H), 3.02-3.09 (m, 4H), 2.40-2.47 (m, 2H), 2.10 (s, 9H), 1.99 (s, 9H), 1.89 (s, 9H), 1.77 (s, 9H), 1.57-1.68 (m, 2H). MS (ESI) [M+H]$^+$ m/z: 816.4.

A 2 L hydrogenation kettle was rendered inert with argon before carefully adding dry Pd/C (9 g), followed by MeOH (50 mL) to moisten the Pd/C. Next, a solution of Compound 8 (90 g, 55.1 mmol, 1.00 eq.) and trifluoroacetic acid (6.29 g, 55.1 mmol, 1.00 eq.) in MeOH (850 mL) was slowly added under an argon atmosphere. The mixture was degassed/displaced by adding H$_2$ three times to give a hydrogen atmosphere, and stirred at 25° C. for 10 hours. LCMS showed complete conversion of Compound 8. Pd/C was removed by filtration, and the filtrate was concentrated under reduced pressure to obtain compound 9 (80 g, yield 90.2%). $^1$H NMR (400 MHz in DMSO-d$_6$): δ ppm 9.12 (br s, 2H), 8.50 (br t, J=5.19 Hz, 1H), 8.10 (br t, J=5.50 Hz, 2H), 7.85-7.91 (m, 3H), 5.22 (d, J=3.25 Hz, 3H), 4.95-5.01 (m, 3H), 4.52-4.58 (m, 3H), 4.03 (s, 9H), 3.84-3.93 (m, 3H), 3.75-3.83 (m, 3H), 3.39-3.61 (m, 16H), 3.23-3.32 (m, 6H), 3.15-3.18 (m, 3H), 2.97-3.05 (m, 2H), 2.54-2.61 (m, 2H), 2.10 (s, 9H), 2.00 (s, 9H), 1.89 (s, 9H), 1.77-1.80 (m, 9H), 1.70-1.76 (m, 2H). MS (ESI) [M+H]$^+$ m/z: 749.3.

To a dichloromethane (2.7 L) solution of Compound 9 (270 g, 168 mmol, 1.00 eq.) and glutaric anhydride (28.6 g, 252 mmol, 1.50 eq.) was added triethylamine (67.8 g, 672 mmol, 4.00 eq.), and the solution was stirred at 25° C. for 1 hour. LCMS showed that Compound 9 was completely converted to Compound 11. 4-Hydroxypiperidine (42.4 g, 420 mmol, 2.50 eq.) and TBTU (107 g, 335 mmol, 2.00 eq.)

were added to the reaction solution, and stirring continued at 25° C. for 1 hour. LCMS showed complete conversion of Compound 11. The reaction was quenched by slowly adding saturated NH$_4$Cl (3.0 L), the layers were separated, and the aqueous phase was extracted with dichloromethane (2×1000 mL) and combined with the previous organic phase. The combined organic phases were washed with a 1:1 mixture of saturated NaHCO$_3$(aq) and saturated brine (3.0 L), dried over anhydrous Na$_2$SO$_4$, filtered and concentrated under reduced pressure. The crude product was dissolved in 1.5 L of dichloromethane and added dropwise to methyl tert-butyl ether (7.5 L). A translucent white precipitate gradually formed during the dropwise addition. The precipitate was filtered under vacuum, and the solid was collected and dried under vacuum to obtain Compound 13 as a white solid. (207 g, yield 72.8%). $^1$H NMR (400 MHz in DMSO-d$_6$): δ ppm 8.05 (br d, J=2.00 Hz, 2H), 7.82 (br d, J=7.38 Hz, 3H), 5.21 (br s, 3H), 4.98 (br d, J=10.26 Hz, 3H), 4.72 (br s, 1H), 4.54 (br d, J=7.88 Hz, 3H), 4.03 (br s, 9H), 3.74-3.94 (m, 9H), 3.45-3.71 (m, 12H), 3.40 (br s, 6H), 3.24 (br s, 7H), 3.07 (br d, J=14.13 Hz, 5H), 2.91-3.01 (m, 1H), 2.24-2.44 (m, 5H), 2.20 (br s, 1H), 2.10 (s, 9H), 1.96-2.04 (m, 9H), 1.89 (br s, 9H), 1.74-1.81 (m, 9H), 1.51-1.73 (m, 6H), 1.07-1.36 (m, 3H). MS (ESI) [M+H]$^+$ m/z: 848.0.

To a solution of Compound 13 (200 g, 118 mmol, 1.00 eq.) and tetrazole diisopropylammonium (8.08 g, 47.2 mmol, 0.40 eq.) in dichloromethane (2.0 L) was added 3-bis(diisopropylamino)phosphanyloxypropanenitrile (53.3 g, 177 mmol, 1.50 eq.). The reaction solution was stirred at 40° C. for 2 hours, whereupon LCMS showed that complete conversion of Compound 13. The reaction solution was washed with a 1:1 mixture of saturated NaHCO$_3$ and saturated brine (2.0 L), and dried over anhydrous Na$_2$SO$_4$. The crude product obtained after concentrating the filtrate was dissolved in dichloromethane (1.2 L) and added dropwise to stirred methyl tert-butyl ether (6.0 L). The suspension was filtered, and the filter cake rinsed with tert-butyl ether. The solid was collected and dried under vacuum. The product was dissolved in dichloromethane (1.0 L) and concentrated to dryness. This operation was repeated four times to remove remaining tert-butyl ether and obtain GLPA15 (164 g, yield 73.3%). $^1$H NMR (400 MHz in DMSO-d$_6$): δ ppm 8.05 (br d, J=6.50 Hz, 2H), 7.81 (br d, J=9.01 Hz, 3H), 5.22 (d, J=3.25 Hz, 3H), 4.98 (dd, J=11.26, 3.25 Hz, 3H), 4.55 (br d, J=8.50 Hz, 3H), 4.03 (s, 9H), 3.64-3.97 (m, 12H), 3.55-3.63 (m, 6H), 3.50 (br s, 5H), 3.40 (br d, J=6.13 Hz, 6H), 3.17-3.30 (m, 9H), 3.07 (br d, J=14.26 Hz, 4H), 2.76 (t, J=5.82 Hz, 2H), 2.18-2.47 (m, 6H), 2.10 (s, 9H), 1.99 (s, 9H), 1.89 (s, 9H), 1.78 (s, 9H), 1.52-1.74 (m, 6H), 1.12-1.19 (m, 12H), $^{31}$P NMR (DMSO-d$_6$): ppm δ 145.25. MS (ESI) [M+H]$^+$ m/z: 1895.7.

In some studies, methods are provided for attaching a targeting group comprising GalNAc (also referred to herein as a GalNAc delivery compound) to the 5'-end of the sense strand, which involves the use of GalNAc phosphoramidite (GLPA1) in the final coupling step of solid-phase synthesis, using a synthetic process such as that used in oligonucleotide chain elongation (i.e. the addition of nucleotides to the 5' end of the sense strand) to attach it to the S'-end of the sense strand.

In some studies, methods of attaching a GalNAc-containing targeting group to the 3'-end of the sense strand comprise the use of a GLO-n-containing solid support (CPG). In some studies, methods of attaching a GalNAc-containing targeting group to the 3'-end of the sense strand comprise linking the GalNAc targeting group to a CPG solid support via an ester bond, and using the resulting CPG with attached GalNAc targeting group during synthesis of the sense strand, which results in the GalNAc targeting group being attached to the 3'-end of the sense strand. Other GalNAc phosphoramidite compounds (GLPAn) can likewise be obtained after the use of reasonably corresponding intermediates by employing methods that are similar to those herein or well-known in the art, and can be connected to the appropriate position of the siRNA duplex as a targeting group.

Example 4. In Vitro Screening of AGT siRNA Duplexes

Hep3B cells were trypsinized and adjusted to an appropriate density, then seeded into 96-well plates. Concurrently with seeding, cells were transfected with test siRNA or control siRNA using Lipofectamine RNAiMax (Invitrogen-13778-150) according to the manufacturer's recommendations. siRNAs were tested in triplicate at two concentrations (0.2 nM to 1.0 nM), while control siRNA was tested in triplicate at eight concentrations in sequential 3-fold dilutions from 4.6 pM to 10 nM.

Twenty-four hours after transfection, the medium was removed and cells were harvested for RNA extraction. Total RNA was extracted using TRIzol™ Reagent (Invitrogen-15596018) according to the manual.

cDNA was synthesized using PrimeScript™ RT Reagent Kit and gDNA Eraser (Perfect Real Time) (TaKaRa-RR047A) according to the manual. AGT cDNA was detected by qPCR. GAPDH cDNA was detected in parallel as an internal control. PCR was performed as follows: 30 seconds at 95° C., followed by 40 cycles between 10 seconds at 95° C. and 30 seconds at 60° C.

Data Analysis

The expression of the AGT gene in each sample was determined by relative quantification (RQ) using the comparative Ct (ΔΔCt) method; this method measures the Ct difference (ΔCt) between the target gene and the housekeeping gene (GAPDH).

The equations are listed below:

$$\Delta CT = \text{target gene mean } Ct - GAPDH \text{ mean } Ct$$

$$\Delta\Delta CT = \Delta CT \text{ (sample)} - \Delta CT \text{ (random control or Lipofectamine } RNAi\text{Max control)}$$

Relative quantification of target gene $mRNA = 2^{(-\Delta\Delta CT)}$

Percent inhibition = (relative quantification of control − relative quantification of sample)/relative quantification of control × 100%.

Table 5 provides the experimental results of in vitro studies on the inhibition of AGT expression using various AGT RNAi agents; the double-stranded sequences used correspond to the compounds shown in Table 2.

| | Average inhibition % | | | |
| --- | --- | --- | --- | --- |
| | 1 nM | | 0.2 nM | |
| Duplex AD# | Mean | SD | Mean | SD |
| AD00051 | 63.49 | 5.27 | 57.80 | 4.84 |
| AD00053 | 82.93 | 1.46 | 60.04 | 3.22 |
| AD00054 | 81.76 | 0.05 | 27.18 | 12.85 |

-continued

| | Average inhibition % | | | |
|---|---|---|---|---|
| | 1 nM | | 0.2 nM | |
| Duplex AD# | Mean | SD | Mean | SD |
| AD00055 | 63.11 | 2.61 | 27.67 | 13.05 |
| AD00056 | 44.67 | 3.42 | −10.57 | 8.88 |
| AD00057 | 38.36 | 1.00 | 6.39 | 2.89 |
| AD00058 | −6.34 | 7.17 | −10.93 | 13.00 |
| AD00059 | 40.95 | 2.41 | −15.25 | 11.41 |
| AD00060 | 41.58 | 1.21 | 1.71 | 1.62 |
| AD00061 | 34.74 | 7.07 | −52.46 | 7.61 |
| AD00062 | 11.16 | 3.26 | −27.82 | 22.96 |
| AD00063 | 25.99 | 1.34 | −28.28 | 34.49 |
| AD00064 | 48.56 | 10.83 | −22.86 | 4.06 |
| AD00065 | 17.68 | 12.71 | −19.42 | 11.46 |
| AD00066 | 74.76 | 0.61 | 32.99 | 9.82 |
| AD00067 | −15.01 | 11.39 | −70.58 | 12.60 |
| AD00068 | 48.42 | 7.31 | 10.85 | 3.85 |
| AD00070 | 14.21 | 6.91 | −41.65 | 19.32 |
| AD00071 | 71.20 | 0.94 | 40.90 | 9.35 |
| AD00072 | 58.69 | 3.25 | −30.13 | 4.78 |
| AD00073 | 23.87 | 7.61 | −10.98 | 10.03 |
| AD00074 | 78.21 | 3.00 | −13.57 | 4.32 |
| AD00075 | 38.92 | 2.08 | 20.51 | 2.14 |
| AD00076 | 73.89 | 1.40 | 52.43 | 1.99 |
| AD00077 | 73.85 | 1.28 | 56.13 | 1.41 |
| AD00078 | 51.59 | 4.46 | −24.43 | 20.40 |
| AD00079 | 90.61 | 0.61 | 76.62 | 5.02 |
| AD00080 | 88.44 | 1.14 | 16.00 | 15.09 |
| AD00081 | 88.79 | 1.96 | 29.91 | 20.77 |
| AD00082 | 77.98 | 0.45 | 60.15 | 10.15 |
| AD00083 | −25.46 | 6.04 | −24.08 | 6.71 |
| AD00084 | 29.29 | 3.07 | −19.97 | 13.61 |
| AD00085 | 54.82 | 2.64 | 6.94 | 4.85 |
| AD00086 | 61.17 | 2.03 | 26.87 | 16.50 |
| AD00087 | 52.12 | 5.08 | −42.78 | 64.89 |
| AD00088 | 17.16 | 13.36 | −25.66 | 4.89 |
| AD00090 | 72.23 | 5.81 | 14.30 | 6.12 |
| AD00091 | 27.41 | 2.11 | −53.58 | 26.95 |
| AD00092 | 78.93 | 0.53 | 29.92 | 2.95 |
| AD00093 | 80.84 | 0.97 | 30.70 | 14.04 |
| AD00094 | 57.64 | 7.56 | 35.89 | 9.00 |
| AD00095 | 63.51 | 1.25 | 28.95 | 12.77 |
| AD00097 | 81.91 | 2.26 | 37.49 | 7.94 |
| AD00098 | 74.20 | 0.29 | 57.41 | 2.59 |
| AD00099 | 53.49 | 2.05 | 1.42 | 22.51 |
| AD00100 | 88.90 | 0.91 | 62.84 | 5.16 |
| AD00101 | 66.98 | 2.39 | 11.83 | 13.72 |

Example 5. In Vivo Testing of AGT siRNA Duplexes

To evaluate the in vivo activity of AGT siRNA, mice infected with AAV encoding the human AGT gene were used (4 mice per group). Fourteen days before siRNA administration, female C57BL/6J mice were infected by intravenous injection of $1\times10^{11}$ viral particles of adeno-associated virus 8 (AAV8) vector encoding the human AGT gene. On day 0, mice were injected subcutaneously with a single dose of 2.5 mg/kg or 3 mg/kg AGT siRNA agent or PBS. Blood samples were collected on day 0, before siRNA administration, and at the end of day 7. Human AGT protein concentration was measured by ELISA assay according to the manufacturer's recommended protocol (IBL America, Human Angiotensinogen ELISA Kit). Knockdown percentage was calculated by comparing human AGT mRNA levels in mouse livers (determined by qPCR) or human AGT protein levels in plasma samples on day 7 between the siRNA-treated and PBS-treated groups. The results are shown in Tables 6-9.

TABLE 6

AGT single 3 mpk dose screening in AAV-human AGT transduced mice; GalNAc compounds corresponding to the sequence, chemical modification and delivery shown in Table 3 are used, wherein GLO-0 refers to the delivery ligand shown as GalNAc$_3$ in Jayaprakash et al., (2014) *J. Am. Chem. Soc.*, 136, 16958-16961.

| ID# | Percent knockdown of human AGT mRNA in mouse liver as measured by qPCR | Percent knockdown of human AGT in mouse plasma as measured by ELISA |
|---|---|---|
| AD00052 | 86% | 67% |
| AD00113 | 39% | 20% |
| AD00114 | 78% | NA |
| AD00115 | 81% | NA |
| AD00116 | 88% | NA |
| AD00122 | 95% | 83% |
| AD00123 | 89% | 76% |
| AD00124 | 68% | NA |
| AD00125 | 86% | NA |
| AD00126 | 92% | 62% |

NA means not tested.

TABLE 7

AGT single 3 mpk dose screening in AAV-human AGT transduced mice; compounds corresponding to the sequence, chemical modification and delivery shown in Table 3 are used, wherein GLO-0 refers to the delivery ligand shown as GalNAc3 in Jayaprakash et al., (2014) *J. Am. Chem. Soc.*, 136, 16958-16961.

| ID# | Percent knockdown of human AGT mRNA in mouse liver as measured by qPCR | Percent knockdown of human AGT in mouse plasma as measured by ELISA |
|---|---|---|
| AD00052 | 72% | 65% |
| AD00154 | 37% | NA |
| AD00155 | 51% | NA |
| AD00156 | 48% | NA |
| AD00157 | 71% | NA |
| AD00158 | 96% | 87% |
| AD00159 | 94% | 80% |
| AD00160 | 68% | NA |
| AD00161 | 77% | NA |
| AD00162 | 85% | NA |
| AD00163 | 94% | 81% |

NA means not tested.

TABLE 8

AGT single 2.5 mpk dose screening in AAV-human AGT transduced mice; compounds corresponding to the sequence, chemical modification and delivery shown in Table 3 are used, wherein the GLO-0 refers to the delivery ligand shown as GalNAc3 in Jayaprakash et al., (2014) *J. Am. Chem. Soc.*, 136, 16958-16961.

| AD# | Percent knockdown of human AGT mRNA in mouse liver as measured by qPCR |
|---|---|
| AD00052 | 73.2% |
| AD00252 | 25.9% |
| AD00257 | 39.1% |
| AD00260 | 42.2% |
| AD00123 | 74.2% |
| AD00284 | 79.6% |
| AD00158 | 92.7% |
| AD00288 | 86.9% |
| AD00163 | 88.9% |
| AD00289 | 66.3% |
| AD00159 | 85.7% |
| AD00290 | 85.2% |
| AD00285 | 26.4% |
| AD00286 | 54.1% |
| AD00287 | 0.5% |

TABLE 8-continued

AGT single 2.5 mpk dose screening in AAV-human AGT transduced mice; compounds corresponding to the sequence, chemical modification and delivery shown in Table 3 are used, wherein the GLO-0 refers to the delivery ligand shown as GalNAc3 in Jayaprakash et al., (2014) *J. Am. Chem. Soc.*, 136, 16958-16961.

| AD# | Percent knockdown of human AGT mRNA in mouse liver as measured by qPCR |
|---|---|
| AD00256 | 72.3% |
| AD00282 | 81.5% |
| AD00283 | 59.8% |
| AD00291 | −29.9% |
| AD00292 | 78.1% |
| AD00293 | 17.9% |
| AD00294 | 60.8% |
| AD00298 | −14.0% |
| AD00299 | 53.2% |
| AD00300 | 89.4% |
| AD00301 | −47.3% |
| AD00302 | 62.1% |

TABLE 9

AGT single 2.5 mpk dose screening in AAV-human AGT transduced mice; compounds corresponding to the sequence, chemical modification and delivery shown in Table 3 or Table 4 are used, wherein GLO-0 refers to the delivery ligand shown as GalNAc3 in Jayaprakash et al., (2014) *J. Am. Chem. Soc.*, 136, 16958-16961.

| ID# | Percent knockdown of human AGT in mouse plasma as measured by ELISA | Percent knockdown of human AGT mRNA in mouse liver as measured by qPCR |
|---|---|---|
| AD00158 | 86% | NA |
| AD00158-1 | 85% | NA |
| AD00158-2 | 68% | NA |
| AD00122 | 83% | 84% |
| AD00159 | 77% | NA |
| AD00159-1 | 77% | 90% |
| AD00163 | 81% | 76% |
| AD00163-1 | 89% | 90% |
| AD00300 | 66% | NA |
| AD00300-1 | 69% | 69% |

NA means not tested.

Example 6. In Vivo Testing of AGT siRNA Duplexes

In order to evaluate the in vivo activity of AGT siRNA, a total of 15 male cynomolgus monkeys (13-22 years old, weight 7-9 kg) were recruited in this study. The animals were randomly divided into 5 groups of three animals each, and each animal was injected subcutaneously with 2 mg/kg test substance, where the test substance used corresponds to the compounds shown in Table 4 (AD00158-1, AD00158-2, AD00163-1, AD00159-1, AD00300-1).

After overnight fasting, blood was collected on days −14 (pre-dosing), −7 (pre-dosing), 1 (pre-dosing) and post-dosing days 8, 15, 22, 29, 43, 57, 64, 71, 78, 85 and 92. The collected blood samples were then left at room temperature for at least 30 minutes to coagulate, and then centrifuged at 350 rpm for 10 minutes at 4° C. The collected serum (approximately 1.0 mL) was transferred into two pre-labeled polypropylene screw cap vials (0.5 ml/vial, one for ELISA assay and the other for later use) and stored in a −80° C. freezer until testing.

AGT protein levels in serum were determined by ELISA. The percentage remaining compared to the AGT levels in the plasma of the monkeys on day 1 are shown in FIG. 1.

Example 7. In Vitro Screening of AGT siRNA Duplexes

In vitro research was conducted according to the method of Example 4, and the experimental results shown in Table 10.

Table 10 provides the experimental results of in vitro studies of inhibition of AGT expression using various AGT RNAi agents; the double-stranded sequences used correspond to the compounds shown in Table 2.

| | Average inhibition % | | | |
|---|---|---|---|---|
| | 1 nM | | 0.2 nM | |
| Duplex AD# | Mean | SD | Mean | SD |
| AV01227 | 93.57 | 0.03 | 85.93 | 0.60 |
| AV01228 | 91.34 | 3.40 | 82.13 | 0.53 |
| AV01229 | 80.82 | 3.46 | 56.60 | 1.35 |
| AV01230 | 78.49 | 1.26 | 39.11 | 0.04 |
| AV01231 | 49.54 | 6.13 | 0.54 | 6.09 |
| AV01232 | 80.88 | 1.05 | 53.41 | 1.59 |
| AV01233 | 89.59 | 1.75 | 75.97 | 2.40 |
| AV01234 | 89.20 | 1.86 | 73.90 | 1.12 |
| AV01235 | 86.81 | 0.00 | 70.59 | 3.93 |
| AV01236 | 90.40 | 0.66 | 79.11 | 2.11 |
| AV01237 | 82.94 | 0.71 | 67.31 | 2.28 |
| AV01238 | 84.52 | 0.63 | 71.77 | 1.19 |
| AV01239 | 81.62 | 2.26 | 65.69 | 2.63 |
| AV01240 | 87.57 | 1.05 | 73.71 | 1.72 |
| AV01241 | 88.57 | 0.37 | 75.29 | 1.65 |
| AV01242 | 88.03 | 1.08 | 76.62 | 1.46 |
| AV01243 | 90.29 | 0.30 | 82.39 | 1.85 |
| AV01244 | 86.57 | 0.96 | 75.39 | 2.98 |
| AV01245 | 81.30 | 3.09 | 68.25 | 4.27 |
| AV01246 | 74.37 | 3.11 | 55.34 | 6.77 |
| AV01247 | 63.44 | 8.48 | 39.83 | 6.91 |
| AV01248 | 73.97 | 1.99 | 48.68 | 2.50 |
| AV01249 | 64.97 | 6.78 | 12.91 | 15.95 |
| AV01250 | 88.45 | 0.15 | 70.96 | 0.83 |
| AV01251 | 89.94 | 0.35 | 72.82 | 2.77 |
| AV01252 | 87.26 | 1.72 | 65.79 | 2.21 |
| AV01253 | 86.71 | 2.13 | 66.42 | 0.25 |
| AV01254 | 90.45 | 0.53 | 81.11 | 1.59 |
| AV01255 | 89.78 | 0.42 | 83.48 | 2.51 |
| AV01256 | 89.36 | 0.69 | 78.84 | 0.72 |
| AV01257 | 92.88 | 0.13 | 85.27 | 0.49 |

Example 8. In Vivo Testing of AD00163-3 in an AAV Mouse Model

After the adaptation period, 12 female C57BL/6J mice were randomly divided into two groups according to body weight: a model (solvent) group and an AD00163-3 (1 mg/kg) group. The animal model was established by injecting $1 \times 10^{11}$ vg of AAV-AGT virus into the caudal vein of each mouse on day 1, injecting a volume of 100 μL/animal. On day 15, the mice in each group were given PBS or AD00163-3 in Table 4 by subcutaneous injection, administering a volume of 5 mL/kg. Before administration on day 15, blood was collected from each mouse through the submandibular vein, and serum samples were collected after centrifugation. On day 22, all mice were sacrificed using $CO_2$, whole blood was collected by cardiac puncture, and serum samples were collected after centrifugation. Human AGT protein concentration was measured by ELISA assay according to the manufacturer's recommended protocol (IBL America, Human Angiotensinogen ELISA Kit). Knockdown percentage was calculated by comparing human-derived AGT protein levels in mouse plasma samples on day 7 (after administration) between the siRNA-treated group and the PBS-treated group. The data showed that AD00163-3 (1 mg/kg) treatment could significantly reduce the expression of human AGT protein in mouse serum by 91%.

Figure 2:
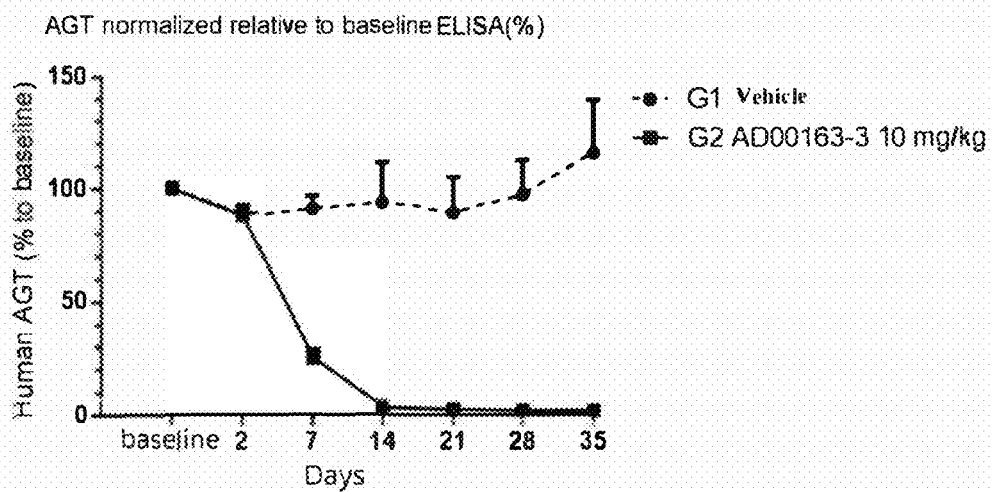
FIG. 2 is a graph showing the serum AGT protein levels in cynomolgus monkeys after administration of 10 mg/kg AD00163-3.
Figure 3:
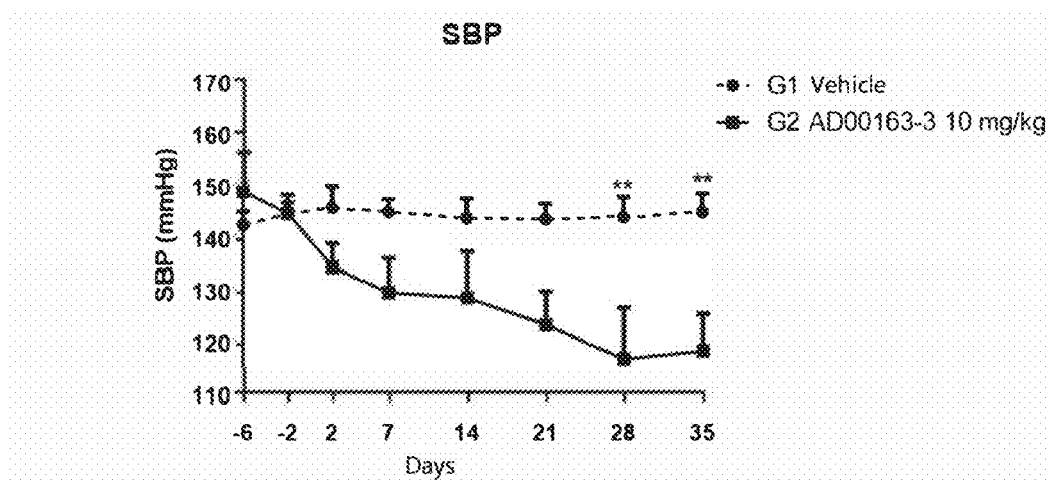
FIG. 3 is a graph showing the changes in serum SBP of cynomolgus monkeys after administration of 10 mg/kg AD00163-3.
Figure 4:
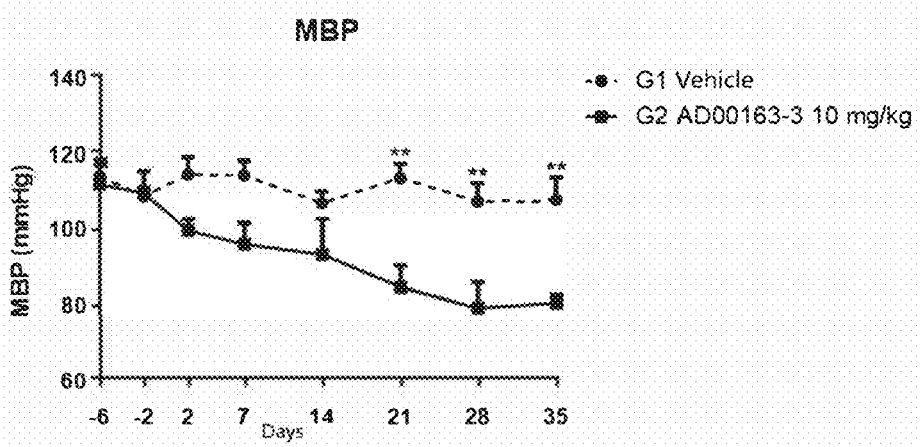
FIG. 4 is a graph showing the mean blood pressure (MBP) of cynomolgus monkeys after administration of 10 mg/kg AD00163-3.
Figure 5:
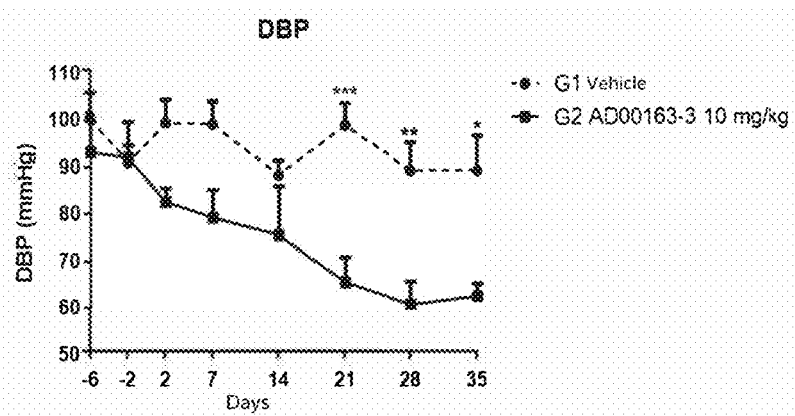
FIG. 5 is a graph showing the diastolic blood pressure (DBP) in cynomolgus monkeys after administration of 10 mg/kg AD00163-3.

Example 9. Testing of AD00163-3 in a Spontaneous Hypertension Model of Cynomolgus Monkeys Ten cynomolgus monkeys with elevated blood pressure were randomly divided into two groups (5 monkeys in each group) to receive either saline or AD00163-3 in Table 4 at 10 mg/kg. Blood samples were collected on days −6 and −2 (pre-dosing) and days 2, 7, 14, 21, 28 and 35 (post-dosing). Serum AGT concentrations were measured by ELISA according to the manufacturer's recommended protocol, and blood pressure was measured using a tail cuff device. As shown in FIGS. 2 and 3, concurrently with a reduction in serum AGT (98% reduction on day 35 post-dose), a single subcutaneous dose of 10 mg/kg AD00163-3 resulted in a significant decrease in SBP of 28 mmHg on day 35 after administration (SBP went from baseline of 147 mmHg to 119 mmHg), whereas there was no significant change in SBP in the control group during the same period (SBP went from baseline of 144 mmHg to 145 mmHg). Significant reductions in mean and diastolic (MBP and DBP) pressures were also observed as shown in FIGS. 4 and 5, respectively.

Equivalents Although several embodiments of the present invention have been described and illustrated herein, it will be readily understood by one of ordinary skill in the art that various other means and/or structures may be used to perform the functions described herein and/or obtain the results and/or one or more advantages, and that each of these variations and/or modifications are considered to be within the scope of the invention. More generally, one skilled in the art will readily appreciate that all parameters, dimensions, materials, and configurations described herein are exemplary and that the actual parameters, dimensions, materials, and/or configurations will depend on the specific applications for which the teachings of the present invention are used. One skilled in the art will recognize, or be able to ascertain using no more than routine experimentation, many equivalents to the specific embodiments of the invention described herein. It is, therefore, to be understood, that the foregoing embodiments are presented by way of example only and that within the scope of the appended claims and their equivalents, the invention may be practiced otherwise than as specifically described and claimed. The present invention is directed to each individual feature, system, article, material and/or method described herein. Further, any combination of two or more such features, systems, articles, materials and/or methods is also included within the scope of the invention provided that such features, systems, articles, materials and/or methods are not mutually inconsistent.

All definitions, as defined and used herein, should be understood as control dictionary definitions, definitions in documents incorporated by reference, and/or ordinary meanings of the defined terms.

Where a quantitative limitation is not used in the description and claims, this should be understood as "at least one" unless expressly stated to the contrary.

As used in the description and claims, the phrase "and/or" should be understood to mean "one or both" of the elements thus combined, i.e. such elements appear combined in certain cases and separately in other cases. In addition to elements specifically identified by "and/or", other elements may optionally be present, whether related or unrelated to those specifically identified elements, unless expressly stated to the contrary.

All references, patents and patent applications and publications cited or referenced in this application are hereby incorporated by reference in their entirety.

SEQUENCE LISTING (673 sequences)

SEQ ID NO: 1 - RNA, 21 nt, synthetic construct
  source 1..21: mol_type = other RNA
gcgtcatccacaatgagagta

SEQ ID NO: 2 - RNA, 21 nt, synthetic construct
  source 1..21: mol_type = other RNA
gtcatccacaatgagagtaca

SEQ ID NO: 3 - RNA, 21 nt, synthetic construct
  source 1..21: mol_type = other RNA
gatccacaatgagagtaccta

SEQ ID NO: 4 - RNA, 21 nt, synthetic construct
  source 1..21: mol_type = other RNA
gtccacaatgagagtacctga

SEQ ID NO: 5 - RNA, 21 nt, synthetic construct
  source 1..21: mol_type = other RNA
gttcttgggcttccgtatata

SEQ ID NO: 6 - RNA, 21 nt, synthetic construct
  source 1..21: mol_type = other RNA
gttgggcttccgtatatatga

SEQ ID NO: 7 - RNA, 21 nt, synthetic construct
  source 1..21: mol_type = other RNA
gtgggcttccgtatatatgga

SEQ ID NO: 8 - RNA, 21 nt, synthetic construct
  source 1..21: mol_type = other RNA
ggcttccgtatatatggcata

SEQ ID NO: 9 - RNA, 21 nt, synthetic construct
  source 1..21: mol_type = other RNA
gcttccgtatatatggcatga

SEQ ID NO: 10 - RNA, 21 nt, synthetic construct
  source 1..21: mol_type = other RNA
gcgtatatatggcatgcacaa

SEQ ID NO: 11 - RNA, 21 nt, synthetic construct
  source 1..21: mol_type = other RNA
ggttccttggaaggacaagaa

SEQ ID NO: 12 - RNA, 21 nt, synthetic construct
  source 1..21: mol_type = other RNA
gagaagattgacaggttcata

SEQ ID NO: 13 - RNA, 21 nt, synthetic construct
  source 1..21: mol_type = other RNA
gatgcaggctgtgacaggata

SEQ ID NO: 14 - RNA, 21 nt, synthetic construct
  source 1..21: mol_type = other RNA
ggagttctgggtggacaacaa

SEQ ID NO: 15 - RNA, 21 nt, synthetic construct
  source 1..21: mol_type = other RNA
gcaacagcacctcagtgtcta

SEQ ID NO: 16 - RNA, 21 nt, synthetic construct
  source 1..21: mol_type = other RNA
ggggtctcactttccagcaaa

SEQ ID NO: 17 - RNA, 21 nt, synthetic construct
  source 1..21: mol_type = other RNA
gtcactttccagcaaaactca

SEQ ID NO: 18 - RNA, 21 nt, synthetic construct
  source 1..21: mol_type = other RNA
gccagcaaaactccctcaaca

SEQ ID NO: 19 - RNA, 21 nt, synthetic construct
  source 1..21: mol_type = other RNA
gagcaaaactccctcaactga

SEQ ID NO: 20 - RNA, 21 nt, synthetic construct
  source 1..21: mol_type = other RNA
ggagctgaacctgcaaaaata

SEQ ID NO: 21 - RNA, 21 nt, synthetic construct
  source 1..21: mol_type = other RNA
gctgaacctgcaaaaattgaa

SEQ ID NO: 22 - RNA, 21 nt, synthetic construct
  source 1..21: mol_type = other RNA
ggaaccgcccattcctgttta

SEQ ID NO: 23 - RNA, 21 nt, synthetic construct
  source 1..21: mol_type = other RNA
gaaccgcccattcctgtttga

SEQ ID NO: 24 - RNA, 21 nt, synthetic construct
  source 1..21: mol_type = other RNA
gttcctgtttgctgtgtatga

SEQ ID NO: 25 - RNA, 21 nt, synthetic construct
  source 1..21: mol_type = other RNA
gctgtttgctgtgtatgatca

SEQ ID NO: 26 - RNA, 21 nt, synthetic construct
  source 1..21: mol_type = other RNA
gtgtttgctgtgtatgatcaa

SEQ ID NO: 27 - RNA, 21 nt, synthetic construct
  source 1..21: mol_type = other RNA
gttgctgtgtatgatcaaaga

SEQ ID NO: 28 - RNA, 21 nt, synthetic construct
  source 1..21: mol_type = other RNA
gtcccaccttttcttctaata

SEQ ID NO: 29 - RNA, 21 nt, synthetic construct
  source 1..21: mol_type = other RNA
gaccttttcttctaatgagta

SEQ ID NO: 30 - RNA, 21 nt, synthetic construct
  source 1..21: mol_type = other RNA
gccttttcttctaatgagtca

SEQ ID NO: 31 - RNA, 21 nt, synthetic construct
  source 1..21: mol_type = other RNA
gcgtttctccttggtctaaga

SEQ ID NO: 32 - RNA, 21 nt, synthetic construct
  source 1..21: mol_type = other RNA
gtttctccttggtctaagtga

SEQ ID NO: 33 - RNA, 21 nt, synthetic construct
  source 1..21: mol_type = other RNA
ggtttgctgggtttattttaa

SEQ ID NO: 34 - RNA, 21 nt, synthetic construct
  source 1..21: mol_type = other RNA
gtttgctgggtttattttaga

SEQ ID NO: 35 - RNA, 21 nt, synthetic construct
  source 1..21: mol_type = other RNA
gttgctgggtttattttagaa

SEQ ID NO: 36 - RNA, 21 nt, synthetic construct
  source 1..21: mol_type = other RNA
ggggtttattttagagaatga

SEQ ID NO: 37 - RNA, 21 nt, synthetic construct
  source 1..21: mol_type = other RNA
gggtttattttagagaatgga

SEQ ID NO: 38 - RNA, 21 nt, synthetic construct
  source 1..21: mol_type = other RNA
gggcaagaaccagtgtttaga

SEQ ID NO: 39 - RNA, 21 nt, synthetic construct
  source 1..21: mol_type = other RNA
ggcaagaaccagtgtttagca

SEQ ID NO: 40 - RNA, 21 nt, synthetic construct
  source 1..21: mol_type = other RNA
gcaagaaccagtgtttagcga

SEQ ID NO: 41 - RNA, 21 nt, synthetic construct
  source 1..21: mol_type = other RNA
gctgttccaaaaagaattcca

SEQ ID NO: 42 - RNA, 21 nt, synthetic construct
  source 1..21: mol_type = other RNA
ggttccaaaaagaattccaaa

SEQ ID NO: 43 - RNA, 21 nt, synthetic construct
  source 1..21: mol_type = other RNA
gttccaaaaagaattccaaca

SEQ ID NO: 44 - RNA, 21 nt, synthetic construct
  source 1..21: mol_type = other RNA
gcaaaaagaattccaaccgaa

SEQ ID NO: 45 - RNA, 21 nt, synthetic construct
  source 1..21: mol_type = other RNA
gaaaaagaattccaaccgaca

SEQ ID NO: 46 - RNA, 21 nt, synthetic construct
  source 1..21: mol_type = other RNA
gcaaccgaccagcttgtttga

SEQ ID NO: 47 - RNA, 21 nt, synthetic construct
  source 1..21: mol_type = other RNA
gaaccgaccagcttgtttgta

SEQ ID NO: 48 - RNA, 21 nt, synthetic construct
  source 1..21: mol_type = other RNA
ggaccagcttgtttgtgaaaa

SEQ ID NO: 49 - RNA, 21 nt, synthetic construct
  source 1..21: mol_type = other RNA
gaccagcttgtttgtgaaaca

SEQ ID NO: 50 - RNA, 21 nt, synthetic construct
  source 1..21: mol_type = other RNA
gccagcttgtttgtgaaacaa

SEQ ID NO: 51 - RNA, 21 nt, synthetic construct
  source 1..21: mol_type = other RNA
gtcatccacaatgagagtaca

SEQ ID NO: 52 - RNA, 21 nt, synthetic construct
  source 1..21: mol_type = other RNA
gtgggcttccgtatatatgga

SEQ ID NO: 53 - RNA, 21 nt, synthetic construct
  source 1..21: mol_type = other RNA
gctgtttgctgtgtatgatca

SEQ ID NO: 54 - RNA, 21 nt, synthetic construct
  source 1..21: mol_type = other RNA
ggtttgctgggtttattttaa

SEQ ID NO: 55 - RNA, 21 nt, synthetic construct
  source 1..21: mol_type = other RNA
gccagcttgtttgtgaaacaa

SEQ ID NO: 56 - RNA, 21 nt, synthetic construct
  source 1..21: mol_type = other RNA
gtcccaccttttcttctaata

SEQ ID NO: 57 - RNA, 21 nt, synthetic construct
  source 1..21: mol_type = other RNA
gccttttcttctaatgagtca

SEQ ID NO: 58 - RNA, 21 nt, synthetic construct
  source 1..21: mol_type = other RNA
ggggtttattttagagaatga

SEQ ID NO: 59 - RNA, 21 nt, synthetic construct
  source 1..21: mol_type = other RNA
ggttccaaaaagaattccaaa

SEQ ID NO: 60 - RNA, 21 nt, synthetic construct
  source 1..21: mol_type = other RNA
gttccaaaaagaattccaaca

SEQ ID NO: 61 - RNA, 21 nt, synthetic construct
  source 1..21: mol_type = other RNA
catccacaatgagagtaccta

SEQ ID NO: 62 - RNA, 21 nt, synthetic construct
  source 1..21: mol_type = other RNA
cttcttgggcttccgtatata

SEQ ID NO: 63 - RNA, 21 nt, synthetic construct
  source 1..21: mol_type = other RNA
catgcaggctgtgacaggata

SEQ ID NO: 64 - RNA, 21 nt, synthetic construct
  source 1..21: mol_type = other RNA
gctgaacctgcaaaaattgaa

SEQ ID NO: 65 - RNA, 21 nt, synthetic construct
  source 1..21: mol_type = other RNA
caccttttcttctaatgagta

SEQ ID NO: 66 - RNA, 21 nt, synthetic construct
  source 1..21: mol_type = other RNA
ccgtttctccttggtctaaga

SEQ ID NO: 67 - RNA, 21 nt, synthetic construct
  source 1..21: mol_type = other RNA
actgttccaaaaagaattcca

SEQ ID NO: 68 - RNA, 21 nt, synthetic construct
  source 1..21: mol_type = other RNA
caaaaagaattccaaccgaca

SEQ ID NO: 69 - RNA, 21 nt, synthetic construct
  source 1..21: mol_type = other RNA
cgaccagcttgtttgtgaaaa

SEQ ID NO: 70 - RNA, 21 nt, synthetic construct
  source 1..21: mol_type = other RNA
gaccagcttgtttgtgaaaca

SEQ ID NO: 71 - RNA, 21 nt, synthetic construct
  source 1..21: mol_type = other RNA
tcgtcatccacaatgagagta

SEQ ID NO: 72 - RNA, 21 nt, synthetic construct
  source 1..21: mol_type = other RNA
gtccacaatgagagtacctga

SEQ ID NO: 73 - RNA, 21 nt, synthetic construct
  source 1..21: mol_type = other RNA
agggtctcactttccagcaaa

SEQ ID NO: 74 - RNA, 21 nt, synthetic construct
  source 1..21: mol_type = other RNA
ctgtttgctgtgtatgatcaa

SEQ ID NO: 75 - RNA, 21 nt, synthetic construct
  source 1..21: mol_type = other RNA
tttgctgtgtatgatcaaaga

SEQ ID NO: 76 - RNA, 21 nt, synthetic construct
  source 1..21: mol_type = other RNA
gtttctccttggtctaagtga

SEQ ID NO: 77 - RNA, 21 nt, synthetic construct
  source 1..21: mol_type = other RNA
gcaagaaccagtgtttagcga

SEQ ID NO: 78 - RNA, 21 nt, synthetic construct
  source 1..21: mol_type = other RNA
ccaaaaagaattccaaccgaa

SEQ ID NO: 79 - RNA, 21 nt, synthetic construct
  source 1..21: mol_type = other RNA
caaccgaccagcttgtttgta

SEQ ID NO: 80 - RNA, 21 nt, synthetic construct
  source 1..21: mol_type = other RNA
gaccttttcttctaatgagta

SEQ ID NO: 81 - RNA, 21 nt, synthetic construct
  source 1..21: mol_type = other RNA
gacctttctttctagcgagta

SEQ ID NO: 82 - RNA, 21 nt, synthetic construct
  source 1..21: mol_type = other RNA
gaccttttcttctaatgagta

SEQ ID NO: 83 - RNA, 21 nt, synthetic construct
  source 1..21: mol_type = other RNA
caccagcttgtttgtgaaaca

SEQ ID NO: 84 - RNA, 21 nt, synthetic construct
  source 1..21: mol_type = other RNA
caccagcttgtttgtgaaaca

SEQ ID NO: 85 - RNA, 21 nt, synthetic construct
  source 1..21: mol_type = other RNA
gcgtttctccttggtctaaga

SEQ ID NO: 86 - RNA, 21 nt, synthetic construct
  source 1..21: mol_type = other RNA
gcgtttctccttggtctaaga

SEQ ID NO: 87 - RNA, 21 nt, synthetic construct
  source 1..21: mol_type = other RNA
gcaaaaagaattccaaccgaa

SEQ ID NO: 88 - RNA, 19 nt, synthetic construct
  source 1..19: mol_type = other RNA
ccttttcttctaatgagta

SEQ ID NO: 89 - RNA, 19 nt, synthetic construct
  source 1..19: mol_type = other RNA
ccagcttgtttgtgaaaca

SEQ ID NO: 90 - RNA, 19 nt, synthetic construct
  source 1..19: mol_type = other RNA
gtttctccttggtctaaga

SEQ ID NO: 91 - RNA, 19 nt, synthetic construct
  source 1..19: mol_type = other RNA
aaaaagaattccaaccgaa

SEQ ID NO: 92 - RNA, 19 nt, synthetic construct
  source 1..19: mol_type = other RNA
cccaccttttcttctaata

SEQ ID NO: 93 - RNA, 19 nt, synthetic construct
  source 1..19: mol_type = other RNA
ccttttcttctaatgagtt

SEQ ID NO: 94 - RNA, 19 nt, synthetic construct
  source 1..19: mol_type = other RNA
ccagcttgtttgtgaaact

SEQ ID NO: 95 - RNA, 19 nt, synthetic construct
  source 1..19: mol_type = other RNA
gtttctccttggtctaagt

SEQ ID NO: 96 - RNA, 19 nt, synthetic construct
  source 1..19: mol_type = other RNA
aaaaagaattccaaccgat

SEQ ID NO: 97 - RNA, 19 nt, synthetic construct
  source 1..19: mol_type = other RNA
cccaccttttcttctaatt

SEQ ID NO: 98 - RNA, 21 nt, synthetic construct
  source 1..21: mol_type = other RNA
tactctcattgtggatgacgc

SEQ ID NO: 99 - RNA, 21 nt, synthetic construct
  source 1..21: mol_type = other RNA
tgtactctcattgtggatgac

SEQ ID NO: 100 - RNA, 21 nt, synthetic construct
  source 1..21: mol_type = other RNA
taggtactctcattgtggatc

SEQ ID NO: 101 - RNA, 21 nt, synthetic construct
  source 1..21: mol_type = other RNA
tcaggtactctcattgtggac

SEQ ID NO: 102 - RNA, 21 nt, synthetic construct
  source 1..21: mol_type = other RNA
tatatacggaagcccaagaac

SEQ ID NO: 103 - RNA, 21 nt, synthetic construct
  source 1..21: mol_type = other RNA
tcatatatacggaagcccaac

SEQ ID NO: 104 - RNA, 21 nt, synthetic construct
  source 1..21: mol_type = other RNA
tccatatatacggaagcccac

SEQ ID NO: 105 - RNA, 21 nt, synthetic construct
  source 1..21: mol_type = other RNA
tatgccatatatacggaagcc

SEQ ID NO: 106 - RNA, 21 nt, synthetic construct
  source 1..21: mol_type = other RNA
tcatgccatatatacggaagc

SEQ ID NO: 107 - RNA, 21 nt, synthetic construct
  source 1..21: mol_type = other RNA
ttgtgcatgccatatatacgc

SEQ ID NO: 108 - RNA, 21 nt, synthetic construct
  source 1..21: mol_type = other RNA
ttcttgtccttccaaggaacc

SEQ ID NO: 109 - RNA, 21 nt, synthetic construct
  source 1..21: mol_type = other RNA
tatgaacctgtcaatcttctc

SEQ ID NO: 110 - RNA, 21 nt, synthetic construct
  source 1..21: mol_type = other RNA
tatcctgtcacagcctgcatc

SEQ ID NO: 111 - RNA, 21 nt, synthetic construct
  source 1..21: mol_type = other RNA
ttgttgtccacccagaactcc

SEQ ID NO: 112 - RNA, 21 nt, synthetic construct
  source 1..21: mol_type = other RNA
tagacactgaggtgctgttgc

SEQ ID NO: 113 - RNA, 21 nt, synthetic construct
  source 1..21: mol_type = other RNA
tttgctggaaagtgagacccc

SEQ ID NO: 114 - RNA, 21 nt, synthetic construct
  source 1..21: mol_type = other RNA
tgagttttgctggaaagtgac

SEQ ID NO: 115 - RNA, 21 nt, synthetic construct
  source 1..21: mol_type = other RNA
tgttgagggagttttgctggc

SEQ ID NO: 116 - RNA, 21 nt, synthetic construct
  source 1..21: mol_type = other RNA
tcagttgagggagttttgctc

SEQ ID NO: 117 - RNA, 21 nt, synthetic construct
  source 1..21: mol_type = other RNA
tatttttgcaggttcagctcc

SEQ ID NO: 118 - RNA, 21 nt, synthetic construct
  source 1..21: mol_type = other RNA
ttcaatttttgcaggttcagc

SEQ ID NO: 119 - RNA, 21 nt, synthetic construct
  source 1..21: mol_type = other RNA
taaacaggaatgggcggttcc

SEQ ID NO: 120 - RNA, 21 nt, synthetic construct
  source 1..21: mol_type = other RNA
tcaaacaggaatgggcggttc

SEQ ID NO: 121 - RNA, 21 nt, synthetic construct
  source 1..21: mol_type = other RNA
tcatacacagcaaacaggaac

SEQ ID NO: 122 - RNA, 21 nt, synthetic construct
  source 1..21: mol_type = other RNA
tgatcatacacagcaaacagc

SEQ ID NO: 123 - RNA, 21 nt, synthetic construct
  source 1..21: mol_type = other RNA
ttgatcatacacagcaaacac

SEQ ID NO: 124 - RNA, 21 nt, synthetic construct
  source 1..21: mol_type = other RNA
tctttgatcatacacagcaac

SEQ ID NO: 125 - RNA, 21 nt, synthetic construct
  source 1..21: mol_type = other RNA
tattagaagaaaaggtgggac

SEQ ID NO: 126 - RNA, 21 nt, synthetic construct
  source 1..21: mol_type = other RNA
tactcattagaagaaaaggtc

SEQ ID NO: 127 - RNA, 21 nt, synthetic construct
  source 1..21: mol_type = other RNA
tgactcattagaagaaaaggc

SEQ ID NO: 128 - RNA, 21 nt, synthetic construct
  source 1..21: mol_type = other RNA
tcttagaccaaggagaaacgc

SEQ ID NO: 129 - RNA, 21 nt, synthetic construct
  source 1..21: mol_type = other RNA
tcacttagaccaaggagaaac

SEQ ID NO: 130 - RNA, 21 nt, synthetic construct
  source 1..21: mol_type = other RNA
ttaaaataaacccagcaaacc

SEQ ID NO: 131 - RNA, 21 nt, synthetic construct
  source 1..21: mol_type = other RNA
tctaaaataaacccagcaaac

SEQ ID NO: 132 - RNA, 21 nt, synthetic construct
  source 1..21: mol_type = other RNA
ttctaaaataaacccagcaac

SEQ ID NO: 133 - RNA, 21 nt, synthetic construct
  source 1..21: mol_type = other RNA
tcattctctaaaataaacccc

SEQ ID NO: 134 - RNA, 21 nt, synthetic construct
  source 1..21: mol_type = other RNA
tccattctctaaaataaaccc

SEQ ID NO: 135 - RNA, 21 nt, synthetic construct
  source 1..21: mol_type = other RNA
tctaaacactggttcttgccc

SEQ ID NO: 136 - RNA, 21 nt, synthetic construct
  source 1..21: mol_type = other RNA
tgctaaacactggttcttgcc

SEQ ID NO: 137 - RNA, 21 nt, synthetic construct
  source 1..21: mol_type = other RNA
tcgctaaacactggttcttgc

SEQ ID NO: 138 - RNA, 21 nt, synthetic construct
  source 1..21: mol_type = other RNA
tggaattctttttggaacagc

SEQ ID NO: 139 - RNA, 21 nt, synthetic construct
  source 1..21: mol_type = other RNA
tttggaattctttttggaacc

SEQ ID NO: 140 - RNA, 21 nt, synthetic construct
  source 1..21: mol_type = other RNA
tgttggaattctttttggaac

SEQ ID NO: 141 - RNA, 21 nt, synthetic construct
  source 1..21: mol_type = other RNA
ttcggttggaattctttttgc

SEQ ID NO: 142 - RNA, 21 nt, synthetic construct
  source 1..21: mol_type = other RNA
tgtcggttggaattctttttc

SEQ ID NO: 143 - RNA, 21 nt, synthetic construct
  source 1..21: mol_type = other RNA
tcaaacaagctggtcggttgc

SEQ ID NO: 144 - RNA, 21 nt, synthetic construct
  source 1..21: mol_type = other RNA
tacaaacaagctggtcggttc

SEQ ID NO: 145 - RNA, 21 nt, synthetic construct
  source 1..21: mol_type = other RNA
ttttcacaaacaagctggtcc

SEQ ID NO: 146 - RNA, 21 nt, synthetic construct
  source 1..21: mol_type = other RNA
tgtttcacaaacaagctggtc

SEQ ID NO: 147 - RNA, 21 nt, synthetic construct
  source 1..21: mol_type = other RNA
ttgtttcacaaacaagctggc

SEQ ID NO: 148 - RNA, 21 nt, synthetic construct
  source 1..21: mol_type = other RNA
tgtactctcattgtggatgac

SEQ ID NO: 149 - RNA, 21 nt, synthetic construct
  source 1..21: mol_type = other RNA
tccatatatacggaagcccac

SEQ ID NO: 150 - RNA, 21 nt, synthetic construct
  source 1..21: mol_type = other RNA
tgatcatacacagcaaacagc

SEQ ID NO: 151 - RNA, 21 nt, synthetic construct
  source 1..21: mol_type = other RNA
ttaaaataaacccagcaaacc

SEQ ID NO: 152 - RNA, 21 nt, synthetic construct
  source 1..21: mol_type = other RNA
ttgtttcacaaacaagctggc

SEQ ID NO: 153 - RNA, 21 nt, synthetic construct
  source 1..21: mol_type = other RNA
tattagaagaaaaggtgggac

SEQ ID NO: 154 - RNA, 21 nt, synthetic construct
  source 1..21: mol_type = other RNA
tgactcattagaagaaaaggc

SEQ ID NO: 155 - RNA, 21 nt, synthetic construct
  source 1..21: mol_type = other RNA
tcattctctaaaataaacccc

SEQ ID NO: 156 - RNA, 21 nt, synthetic construct
  source 1..21: mol_type = other RNA
tttggaattctttttggaacc

SEQ ID NO: 157 - RNA, 21 nt, synthetic construct
  source 1..21: mol_type = other RNA
tgttggaattctttttggaac

SEQ ID NO: 158 - RNA, 21 nt, synthetic construct
  source 1..21: mol_type = other RNA
taggtactctcattgtggatg

SEQ ID NO: 159 - RNA, 21 nt, synthetic construct
  source 1..21: mol_type = other RNA
tatatacggaagcccaagaag

SEQ ID NO: 160 - RNA, 21 nt, synthetic construct
  source 1..21: mol_type = other RNA
tatcctgtcacagcctgcatg

SEQ ID NO: 161 - RNA, 21 nt, synthetic construct
  source 1..21: mol_type = other RNA
ttcaatttttgcaggttcagc

SEQ ID NO: 162 - RNA, 21 nt, synthetic construct
  source 1..21: mol_type = other RNA
tactcattagaagaaaaggtg

SEQ ID NO: 163 - RNA, 21 nt, synthetic construct
  source 1..21: mol_type = other RNA
tcttagaccaaggagaaacgg

SEQ ID NO: 164 - RNA, 21 nt, synthetic construct
  source 1..21: mol_type = other RNA
tggaattctttttggaacagt

SEQ ID NO: 165 - RNA, 21 nt, synthetic construct
  source 1..21: mol_type = other RNA
tgtcggttggaattctttttg

SEQ ID NO: 166 - RNA, 21 nt, synthetic construct
  source 1..21: mol_type = other RNA
ttttcacaaacaagctggtcg

SEQ ID NO: 167 - RNA, 21 nt, synthetic construct
  source 1..21: mol_type = other RNA
tgtttcacaaacaagctggtc

SEQ ID NO: 168 - RNA, 21 nt, synthetic construct
  source 1..21: mol_type = other RNA
tactctcattgtggatgacga

SEQ ID NO: 169 - RNA, 21 nt, synthetic construct
  source 1..21: mol_type = other RNA
tcaggtactctcattgtggac

SEQ ID NO: 170 - RNA, 21 nt, synthetic construct
  source 1..21: mol_type = other RNA
tttgctggaaagtgagaccct

SEQ ID NO: 171 - RNA, 21 nt, synthetic construct
  source 1..21: mol_type = other RNA
ttgatcatacacagcaaacag

SEQ ID NO: 172 - RNA, 21 nt, synthetic construct
  source 1..21: mol_type = other RNA
tctttgatcatacacagcaaa

SEQ ID NO: 173 - RNA, 21 nt, synthetic construct
  source 1..21: mol_type = other RNA
tcacttagaccaaggagaaac

SEQ ID NO: 174 - RNA, 21 nt, synthetic construct
  source 1..21: mol_type = other RNA
tcgctaaacactggttcttgc

SEQ ID NO: 175 - RNA, 21 nt, synthetic construct
  source 1..21: mol_type = other RNA
ttcggttggaattctttttgg

SEQ ID NO: 176 - RNA, 21 nt, synthetic construct
  source 1..21: mol_type = other RNA
tacaaacaagctggtcggttg

SEQ ID NO: 177 - RNA, 21 nt, synthetic construct
  source 1..21: mol_type = other RNA
tactcattagaagaaaaggtc

SEQ ID NO: 178 - RNA, 21 nt, synthetic construct
  source 1..21: mol_type = other RNA
tactcattagaagaaaaggtc

SEQ ID NO: 179 - RNA, 21 nt, synthetic construct
  source 1..21: mol_type = other RNA
tactcattagaagaaaaggtc

SEQ ID NO: 180 - RNA, 21 nt, synthetic construct
  source 1..21: mol_type = other RNA
tgtttcacaaacaagctggtg

SEQ ID NO: 181 - RNA, 21 nt, synthetic construct
  source 1..21: mol_type = other RNA
tgtttcacaaacaagctggtg

SEQ ID NO: 182 - RNA, 21 nt, synthetic construct
  source 1..21: mol_type = other RNA
tcttagaccaaggagaaacgc

SEQ ID NO: 183 - RNA, 21 nt, synthetic construct
  source 1..21: mol_type = other RNA
tcttagaccaaggagaaacgc

SEQ ID NO: 184 - RNA, 21 nt, synthetic construct
  source 1..21: mol_type = other RNA
ttcggttggaattctttttgc

SEQ ID NO: 185 - RNA, 19 nt, synthetic construct
  source 1..19: mol_type = other RNA
tactcattagaagaaaagg

SEQ ID NO: 186 - RNA, 19 nt, synthetic construct
  source 1..19: mol_type = other RNA
tgtttcacaaacaagctgg

SEQ ID NO: 187 - RNA, 19 nt, synthetic construct
  source 1..19: mol_type = other RNA
tcttagaccaaggagaaac

SEQ ID NO: 188 - RNA, 19 nt, synthetic construct
  source 1..19: mol_type = other RNA
ttcggttggaattcttttt

SEQ ID NO: 189 - RNA, 19 nt, synthetic construct
  source 1..19: mol_type = other RNA
tattagaagaaaaggtggg

SEQ ID NO: 190 - RNA, 19 nt, synthetic construct
  source 1..19: mol_type = other RNA
aactcattagaagaaaagg

SEQ ID NO: 191 - RNA, 19 nt, synthetic construct
  source 1..19: mol_type = other RNA
agtttcacaaacaagctgg

SEQ ID NO: 192 - RNA, 19 nt, synthetic construct
  source 1..19: mol_type = other RNA
acttagaccaaggagaaac

SEQ ID NO: 193 - RNA, 19 nt, synthetic construct
  source 1..19: mol_type = other RNA
atcggttggaattcttttt

SEQ ID NO: 194 - RNA, 19 nt, synthetic construct
  source 1..19: mol_type = other RNA
aattagaagaaaaggtggg

SEQ ID NO: 195 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gcgtcatccacaatgagagta

SEQ ID NO: 196 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gatccacaatgagagtaccta

SEQ ID NO: 197 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gtccacaatgagagtacctga

SEQ ID NO: 198 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gttcttgggcttccgtatata

SEQ ID NO: 199 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gttgggcttccgtatatatga

SEQ ID NO: 200 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gtgggcttccgtatatatgga

SEQ ID NO: 201 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
ggcttccgtatatatggcata

SEQ ID NO: 202 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gcttccgtatatatggcatga

SEQ ID NO: 203 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gcgtatatatggcatgcacaa

SEQ ID NO: 204 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
ggttccttggaaggacaagaa

SEQ ID NO: 205 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gagaagattgacaggttcata

SEQ ID NO: 206 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gatgcaggctgtgacaggata

SEQ ID NO: 207 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
ggagttctgggtggacaacaa

SEQ ID NO: 208 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gcaacagcacctcagtgtcta

SEQ ID NO: 209 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
ggggtctcactttccagcaaa

SEQ ID NO: 210 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gtcactttccagcaaaactca

SEQ ID NO: 211 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gccagcaaaactccctcaaca

SEQ ID NO: 212 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gagcaaaactccctcaactga

SEQ ID NO: 213 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
ggagctgaacctgcaaaaata

SEQ ID NO: 214 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gctgaacctgcaaaaattgaa

SEQ ID NO: 215 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
ggaaccgcccattcctgttta

SEQ ID NO: 216 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gaaccgcccattcctgtttga

SEQ ID NO: 217 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gttcctgtttgctgtgtatga

SEQ ID NO: 218 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gctgtttgctgtgtatgatca

SEQ ID NO: 219 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gtgtttgctgtgtatgatcaa

SEQ ID NO: 220 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gttgctgtgtatgatcaaaga

SEQ ID NO: 221 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gtcccaccttttcttctaata

SEQ ID NO: 222 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gaccttttcttctaatgagta

SEQ ID NO: 223 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gccttttcttctaatgagtca

SEQ ID NO: 224 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gcgtttctccttggtctaaga

SEQ ID NO: 225 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gtttctccttggtctaagtga

SEQ ID NO: 226 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
ggtttgctgggtttattttaa

SEQ ID NO: 227 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gtttgctgggtttattttaga

SEQ ID NO: 228 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gttgctgggtttattttagaa

SEQ ID NO: 229 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
ggggtttattttagagaatga

SEQ ID NO: 230 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gggtttattttagagaatgga

SEQ ID NO: 231 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gggcaagaaccagtgtttaga

SEQ ID NO: 232 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
ggcaagaaccagtgtttagca

SEQ ID NO: 233 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gcaagaaccagtgtttagcga

SEQ ID NO: 234 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gctgttccaaaaagaattcca

SEQ ID NO: 235 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
ggttccaaaaagaattccaaa

SEQ ID NO: 236 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gttccaaaaagaattccaaca

SEQ ID NO: 237 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gcaaaaagaattccaaccgaa

SEQ ID NO: 238 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gaaaaagaattccaaccgaca

SEQ ID NO: 239 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gcaaccgaccagcttgtttga

SEQ ID NO: 240 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gaaccgaccagcttgtttgta

SEQ ID NO: 241 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
ggaccagcttgtttgtgaaaa

SEQ ID NO: 242 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gaccagcttgtttgtgaaaca

SEQ ID NO: 243 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gccagcttgtttgtgaaacaa

SEQ ID NO: 244 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gtcatccacaatgagagtaca

SEQ ID NO: 245 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tactctcattgtggatgacgc

SEQ ID NO: 246 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
taggtactctcattgtggatc

SEQ ID NO: 247 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcaggtactctcattgtggac

SEQ ID NO: 248 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tatatacggaagcccaagaac

SEQ ID NO: 249 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcatatatacggaagcccaac

SEQ ID NO: 250 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tccatatatacggaagcccac

SEQ ID NO: 251 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tatgccatatatacggaagcc

SEQ ID NO: 252 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcatgccatatatacggaagc

SEQ ID NO: 253 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttgtgcatgccatatatacgc

SEQ ID NO: 254 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttcttgtccttccaaggaacc

SEQ ID NO: 255 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tatgaacctgtcaatcttctc

SEQ ID NO: 256 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tatcctgtcacagcctgcatc

SEQ ID NO: 257 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttgttgtccacccagaactcc

SEQ ID NO: 258 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tagacactgaggtgctgttgc

SEQ ID NO: 259 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tttgctggaaagtgagacccc

SEQ ID NO: 260 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgagttttgctggaaagtgac

SEQ ID NO: 261 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgttgagggagttttgctggc

SEQ ID NO: 262 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcagttgagggagttttgctc

SEQ ID NO: 263 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tatttttgcaggttcagctcc

SEQ ID NO: 264 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttcaatttttgcaggttcagc

SEQ ID NO: 265 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
taaacaggaatgggcggttcc

SEQ ID NO: 266 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcaaacaggaatgggcggttc

SEQ ID NO: 267 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcatacacagcaaacaggaac

SEQ ID NO: 268 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgatcatacacagcaaacagc

SEQ ID NO: 269 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttgatcatacacagcaaacac

SEQ ID NO: 270 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tctttgatcatacacagcaac

SEQ ID NO: 271 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tattagaagaaaaggtgggac

SEQ ID NO: 272 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tactcattagaagaaaaggtc

SEQ ID NO: 273 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgactcattagaagaaaaggc

SEQ ID NO: 274 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcttagaccaaggagaaacgc

SEQ ID NO: 275 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcacttagaccaaggagaaac

SEQ ID NO: 276 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttaaaataaacccagcaaacc

SEQ ID NO: 277 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tctaaaataaacccagcaaac

SEQ ID NO: 278 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttctaaaataaacccagcaac

SEQ ID NO: 279 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcattctctaaaataaacccc

SEQ ID NO: 280 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tccattctctaaaataaaccc

SEQ ID NO: 281 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tctaaacactggttcttgccc

SEQ ID NO: 282 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgctaaacactggttcttgcc

SEQ ID NO: 283 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcgctaaacactggttcttgc

SEQ ID NO: 284 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tggaattctttttggaacagc

SEQ ID NO: 285 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tttggaattctttttggaacc

SEQ ID NO: 286 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgttggaattctttttggaac

SEQ ID NO: 287 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttcggttggaattctttttgc

SEQ ID NO: 288 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtcggttggaattctttttc

SEQ ID NO: 289 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcaaacaagctggtcggttgc

SEQ ID NO: 290 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tacaaacaagctggtcggttc

SEQ ID NO: 291 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttttcacaaacaagctggtcc

SEQ ID NO: 292 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtc

SEQ ID NO: 293 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttgtttcacaaacaagctggc

SEQ ID NO: 294 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtactctcattgtggatgac

SEQ ID NO: 295 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gtcatccacaatgagagtaca

SEQ ID NO: 296 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gtgggcttccgtatatatgga

SEQ ID NO: 297 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gctgtttgctgtgtatgatca

SEQ ID NO: 298 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
ggtttgctgggtttattttaa

SEQ ID NO: 299 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gccagcttgtttgtgaaacaa

SEQ ID NO: 300 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gtcccaccttttcttctaata

SEQ ID NO: 301 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gccttttcttctaatgagtca

SEQ ID NO: 302 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
ggggtttattttagagaatga

SEQ ID NO: 303 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
ggttccaaaaagaattccaaa

SEQ ID NO: 304 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gttccaaaaagaattccaaca

SEQ ID NO: 305 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
catccacaatgagagtaccta

SEQ ID NO: 306 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
cttcttgggcttccgtatata

SEQ ID NO: 307 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
catgcaggctgtgacaggata

SEQ ID NO: 308 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gctgaacctgcaaaaattgaa

SEQ ID NO: 309 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
caccttttcttctaatgagta

SEQ ID NO: 310 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
ccgtttctccttggtctaaga

SEQ ID NO: 311 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
actgttccaaaaagaattcca

SEQ ID NO: 312 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
caaaaagaattccaaccgaca

SEQ ID NO: 313 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
cgaccagcttgtttgtgaaaa

SEQ ID NO: 314 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gaccagcttgtttgtgaaaca

SEQ ID NO: 315 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
tcgtcatccacaatgagagta

SEQ ID NO: 316 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gtccacaatgagagtacctga

SEQ ID NO: 317 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
agggtctcactttccagcaaa

SEQ ID NO: 318 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
ctgtttgctgtgtatgatcaa

SEQ ID NO: 319 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
tttgctgtgtatgatcaaaga

SEQ ID NO: 320 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gtttctccttggtctaagtga

SEQ ID NO: 321 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gcaagaaccagtgtttagcga

SEQ ID NO: 322 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
ccaaaaagaattccaaccgaa

SEQ ID NO: 323 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
caaccgaccagcttgtttgta

SEQ ID NO: 324 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gtcccaccttttcttctaata

SEQ ID NO: 325 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gttccaaaaagaattccaaca

SEQ ID NO: 326 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gccttttcttctaatgagtca

SEQ ID NO: 327 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gccagcttgtttgtgaaacaa

SEQ ID NO: 328 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
ggttccaaaaagaattccaaa

SEQ ID NO: 329 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
ggtttgctgggtttattttaa

SEQ ID NO: 330 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
caccttttcttctaatgagta

SEQ ID NO: 331 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gaccagcttgtttgtgaaaca

SEQ ID NO: 332 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
ccgtttctccttggtctaaga

SEQ ID NO: 333 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
cgaccagcttgtttgtgaaaa

SEQ ID NO: 334 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
caaaaagaattccaaccgaca

SEQ ID NO: 335 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
tcgtcatccacaatgagagta

SEQ ID NO: 336 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gtccacaatgagagtacctga

SEQ ID NO: 337 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
agggtctcactttccagcaaa

SEQ ID NO: 338 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
ctgtttgctgtgtatgatcaa

SEQ ID NO: 339 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
tttgctgtgtatgatcaaaga

SEQ ID NO: 340 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gtttctccttggtctaagtga

SEQ ID NO: 341 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gcaagaaccagtgtttagcga

SEQ ID NO: 342 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
ccaaaaagaattccaaccgaa

SEQ ID NO: 343 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
caaccgaccagcttgtttgta

SEQ ID NO: 344 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtactctcattgtggatgac

SEQ ID NO: 345 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tccatatatacggaagcccac

SEQ ID NO: 346 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgatcatacacagcaaacagc

SEQ ID NO: 347 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttaaaataaacccagcaaacc

SEQ ID NO: 348 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttgtttcacaaacaagctggc

SEQ ID NO: 349 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tattagaagaaaaggtgggac

SEQ ID NO: 350 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgactcattagaagaaaaggc

SEQ ID NO: 351 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcattctctaaaataaacccc

SEQ ID NO: 352 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tttggaattctttttggaacc

SEQ ID NO: 353 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgttggaattctttttggaac

SEQ ID NO: 354 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
taggtactctcattgtggatg

SEQ ID NO: 355 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tatatacggaagcccaagaag

SEQ ID NO: 356 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tatcctgtcacagcctgcatg

SEQ ID NO: 357 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttcaatttttgcaggttcagc

SEQ ID NO: 358 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tactcattagaagaaaaggtg

SEQ ID NO: 359 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcttagaccaaggagaaacgg

SEQ ID NO: 360 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tggaattctttttggaacagt

SEQ ID NO: 361 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtcggttggaattctttttg

SEQ ID NO: 362 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttttcacaaacaagctggtcg

SEQ ID NO: 363 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtc

SEQ ID NO: 364 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tactctcattgtggatgacga

SEQ ID NO: 365 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcaggtactctcattgtggac

SEQ ID NO: 366 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tttgctggaaagtgagaccct

SEQ ID NO: 367 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttgatcatacacagcaaacag

SEQ ID NO: 368 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tctttgatcatacacagcaaa

SEQ ID NO: 369 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcacttagaccaaggagaaac

SEQ ID NO: 370 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcgctaaacactggttcttgc

SEQ ID NO: 371 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttcggttggaattctttttgg

SEQ ID NO: 372 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tacaaacaagctggtcggttg

SEQ ID NO: 373 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tattagaagaaaaggtgggac

SEQ ID NO: 374 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgttggaattctttttggaac

SEQ ID NO: 375 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgactcattagaagaaaaggc

SEQ ID NO: 376 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttgtttcacaaacaagctggc

SEQ ID NO: 377 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tttggaattctttttggaacc

SEQ ID NO: 378 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttaaaataaacccagcaaacc

SEQ ID NO: 379 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tactcattagaagaaaaggtg

SEQ ID NO: 380 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtc

SEQ ID NO: 381 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcttagaccaaggagaaacgg

SEQ ID NO: 382 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttttcacaaacaagctggtcg

SEQ ID NO: 383 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtcggttggaattctttttg

SEQ ID NO: 384 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tactctcattgtggatgacga

SEQ ID NO: 385 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcaggtactctcattgtggac

SEQ ID NO: 386 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tttgctggaaagtgagaccct

SEQ ID NO: 387 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttgatcatacacagcaaacag

SEQ ID NO: 388 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tctttgatcatacacagcaaa

SEQ ID NO: 389 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcacttagaccaaggagaaac

SEQ ID NO: 390 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcgctaaacactggttcttgc

SEQ ID NO: 391 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttcggttggaattctttttgg

SEQ ID NO: 392 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tacaaacaagctggtcggttg

SEQ ID NO: 393 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gtgggcttccgtatatatgga

SEQ ID NO: 394 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gctgtttgctgtgtatgatca

SEQ ID NO: 395 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
ggtttgctgggtttattttaa

SEQ ID NO: 396 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gccagcttgtttgtgaaacaa

SEQ ID NO: 397 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gtcccaccttttcttctaata

SEQ ID NO: 398 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gccttttcttctaatgagtca

SEQ ID NO: 399 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
ggggtttattttagagaatga

SEQ ID NO: 400 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
ggttccaaaaagaattccaaa

SEQ ID NO: 401 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gttccaaaaagaattccaaca

SEQ ID NO: 402 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
catccacaatgagagtaccta

SEQ ID NO: 403 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
cttcttgggcttccgtatata

SEQ ID NO: 404 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
catgcaggctgtgacaggata

SEQ ID NO: 405 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gctgaacctgcaaaaattgaa

SEQ ID NO: 406 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
actgttccaaaaagaattcca

SEQ ID NO: 407 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
caaaaagaattccaaccgaca

SEQ ID NO: 408 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
cgaccagcttgtttgtgaaaa

SEQ ID NO: 409 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
tcgtcatccacaatgagagta

SEQ ID NO: 410 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gtccacaatgagagtacctga

SEQ ID NO: 411 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
agggtctcactttccagcaaa

SEQ ID NO: 412 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
ctgtttgctgtgtatgatcaa

SEQ ID NO: 413 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
tttgctgtgtatgatcaaaga

SEQ ID NO: 414 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gtttctccttggtctaagtga

SEQ ID NO: 415 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gcaagaaccagtgtttagcga

SEQ ID NO: 416 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
ccaaaaagaattccaaccgaa

SEQ ID NO: 417 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
caaccgaccagcttgtttgta

SEQ ID NO: 418 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gtcccaccttttcttctaata

SEQ ID NO: 419 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gttccaaaaagaattccaaca

SEQ ID NO: 420 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gccttttcttctaatgagtca

SEQ ID NO: 421 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gccagcttgtttgtgaaacaa

SEQ ID NO: 422 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
ggttccaaaaagaattccaaa

SEQ ID NO: 423 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
ggtttgctgggtttattttaa

SEQ ID NO: 424 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
caccttttcttctaatgagta

SEQ ID NO: 425 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gaccagcttgtttgtgaaaca

SEQ ID NO: 426 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
ccgtttctccttggtctaaga

SEQ ID NO: 427 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
cgaccagcttgtttgtgaaaa

SEQ ID NO: 428 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
caaaaagaattccaaccgaca

SEQ ID NO: 429 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
tcgtcatccacaatgagagta

SEQ ID NO: 430 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gtccacaatgagagtacctga

SEQ ID NO: 431 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
agggtctcactttccagcaaa

SEQ ID NO: 432 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
ctgtttgctgtgtatgatcaa

SEQ ID NO: 433 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
tttgctgtgtatgatcaaaga

SEQ ID NO: 434 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gtttctccttggtctaagtga

SEQ ID NO: 435 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gcaagaaccagtgtttagcga

SEQ ID NO: 436 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
caaccgaccagcttgtttgta

SEQ ID NO: 437 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
ccaaccgaccagcttgtttga

SEQ ID NO: 438 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gaccttttcttctaatgagta

SEQ ID NO: 439 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gacctttctttctagcgagta

SEQ ID NO: 440 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gaccttttcttctaatgagta

SEQ ID NO: 441 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
caccagcttgtttgtgaaaca

SEQ ID NO: 442 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
caccagcttgtttgtgaaaca

SEQ ID NO: 443 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gcgtttctccttggtctaaga

SEQ ID NO: 444 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
gcgtttctccttggtctaaga

SEQ ID NO: 445 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gcaaaaagaattccaaccgaa

SEQ ID NO: 446 - RNA, 19 nt, synthetic construct
  source 1..19: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide attached to 3'-3' thiophosphate inverted abasic site
ccttttcttctaatgagta

SEQ ID NO: 447 - RNA, 19 nt, synthetic construct
  source 1..19: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide attached to 3'-3' thiophosphate inverted abasic site
ccagcttgtttgtgaaaca

SEQ ID NO: 448 - RNA, 19 nt, synthetic construct
  source 1..19: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide attached to 3'-3' thiophosphate inverted abasic site
gtttctccttggtctaaga

SEQ ID NO: 449 - RNA, 19 nt, synthetic construct
  source 1..19: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide attached to 3'-3' thiophosphate inverted abasic site
aaaaagaattccaaccgaa

SEQ ID NO: 450 - RNA, 19 nt, synthetic construct
  source 1..19: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide attached to 3'-3' thiophosphate inverted abasic site
cccaccttttcttctaata

SEQ ID NO: 451 - RNA, 19 nt, synthetic construct
  source 1..19: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide attached to 3'-3' thiophosphate inverted abasic site
ccttttcttctaatgagtt

SEQ ID NO: 452 - RNA, 19 nt, synthetic construct
  source 1..19: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide attached to 3'-3' thiophosphate inverted abasic site
ccagcttgtttgtgaaact

SEQ ID NO: 453 - RNA, 19 nt, synthetic construct
  source 1..19: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide attached to 3'-3' thiophosphate inverted abasic site
gtttctccttggtctaagt

SEQ ID NO: 454 - RNA, 19 nt, synthetic construct
  source 1..19: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide attached to 3'-3' thiophosphate inverted abasic site
aaaaagaattccaaccgat

SEQ ID NO: 455 - RNA, 19 nt, synthetic construct
  source 1..19: mol_type = other RNA
  modified_base 1: mod_base = OTHER; note = 2'-O-methyl modified nucleotide attached to 5'-5' thiophosphate inverted abasic site which is attached to O-(1-(((2R,3R,4R,5R,6R)-3-acetamido-4,5-dihydroxy-6-(hydrox ymethyl)tetrahydro-2H-pyran-2-yl)oxy)-9,13-bis(2-((2-(2-((( 2R,3R,4R,5R,6R)-3-acetamido-4,5-dihydroxy-6-(hydroxymethyl) tetrahydro-2H-pyran-2-yl)oxy)ethoxy)ethyl)amino)-2-oxoethyl )-7,14-dioxo-3-oxa-6,9,13-triazanonadecan-19-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide attached to 3'-3' thiophosphate inverted abasic site
cccaccttttcttctaatt

SEQ ID NO: 456 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tccatatatacggaagcccac

SEQ ID NO: 457 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgatcatacacagcaaacagc

SEQ ID NO: 458 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttaaaataaacccagcaaacc

SEQ ID NO: 459 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttgtttcacaaacaagctggc

SEQ ID NO: 460 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tattagaagaaaaggtgggac

SEQ ID NO: 461 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgactcattagaagaaaaggc

SEQ ID NO: 462 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcattctctaaaataaacccc

SEQ ID NO: 463 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tttggaattctttttggaacc

SEQ ID NO: 464 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgttggaattctttttggaac

SEQ ID NO: 465 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
taggtactctcattgtggatg

SEQ ID NO: 466 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tatatacggaagcccaagaag

SEQ ID NO: 467 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tatcctgtcacagcctgcatg

SEQ ID NO: 468 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttcaatttttgcaggttcagc

SEQ ID NO: 469 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tggaattctttttggaacagt

SEQ ID NO: 470 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtcggttggaattctttttg

SEQ ID NO: 471 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttttcacaaacaagctggtcg

SEQ ID NO: 472 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tactctcattgtggatgacga

SEQ ID NO: 473 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcaggtactctcattgtggac

SEQ ID NO: 474 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tttgctggaaagtgagaccct

SEQ ID NO: 475 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttgatcatacacagcaaacag

SEQ ID NO: 476 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tctttgatcatacacagcaaa

SEQ ID NO: 477 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcacttagaccaaggagaaac

SEQ ID NO: 478 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcgctaaacactggttcttgc

SEQ ID NO: 479 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttcggttggaattctttttgg

SEQ ID NO: 480 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tacaaacaagctggtcggttg

SEQ ID NO: 481 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tattagaagaaaaggtgggac

SEQ ID NO: 482 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgttggaattctttttggaac

SEQ ID NO: 483 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgactcattagaagaaaaggc

SEQ ID NO: 484 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttgtttcacaaacaagctggc

SEQ ID NO: 485 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tttggaattctttttggaacc

SEQ ID NO: 486 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttaaaataaacccagcaaacc

SEQ ID NO: 487 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tactcattagaagaaaaggtg

SEQ ID NO: 488 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtc

SEQ ID NO: 489 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcttagaccaaggagaaacgg

SEQ ID NO: 490 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttttcacaaacaagctggtcg

SEQ ID NO: 491 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtcggttggaattctttttg

SEQ ID NO: 492 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tactctcattgtggatgacga

SEQ ID NO: 493 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcaggtactctcattgtggac

SEQ ID NO: 494 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tttgctggaaagtgagaccct

SEQ ID NO: 495 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttgatcatacacagcaaacag

SEQ ID NO: 496 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tctttgatcatacacagcaaa

SEQ ID NO: 497 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcacttagaccaaggagaaac

SEQ ID NO: 498 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcgctaaacactggttcttgc

SEQ ID NO: 499 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tacaaacaagctggtcggttg

SEQ ID NO: 500 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcaaacaagctggtcggttgg

SEQ ID NO: 501 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tactcattagaagaaaaggtc

SEQ ID NO: 502 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tactcattagaagaaaaggtc

SEQ ID NO: 503 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tactcattagaagaaaaggtc

SEQ ID NO: 504 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtg

SEQ ID NO: 505 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtg

SEQ ID NO: 506 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcttagaccaaggagaaacgc

SEQ ID NO: 507 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcttagaccaaggagaaacgc

SEQ ID NO: 508 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ttcggttggaattctttttgc

SEQ ID NO: 509 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
tactcattagaagaaaagg

SEQ ID NO: 510 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
tgtttcacaaacaagctgg

SEQ ID NO: 511 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
tcttagaccaaggagaaac

SEQ ID NO: 512 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
ttcggttggaattcttttt

SEQ ID NO: 513 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
tattagaagaaaaggtggg

SEQ ID NO: 514 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
aactcattagaagaaaagg

SEQ ID NO: 515 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
agtttcacaaacaagctgg

SEQ ID NO: 516 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
acttagaccaaggagaaac

SEQ ID NO: 517 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
atcggttggaattcttttt

SEQ ID NO: 518 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
aattagaagaaaaggtggg

SEQ ID NO: 519 - RNA, 2116 nt, Homo sapiens
  source 1..2116: mol_type = mRNA
gaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgatgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactatctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaaccatagctggttatttctcccttgtgttagtaataaacgtcttgccacaataagcctccaaaaa

SEQ ID NO: 520 - RNA, 1434 nt, Mus musculus
  source 1..1434: mol_type = mRNA
atgactcccacgggggcaggcctgaaggccaccatcttctgcatcttgacctgggtcagcctgacggctggggaccgcgtatacatccaccccttccatctcctttaccacaacaagagcacctgcgcccagctggagaaccccagtgtggagacactcccagagtcaacgttcgagcctgtgcccattcaggccaagacctcccctgtgaatgagaagaccctgcatgatcagctcgtgctggccgccgagaagctagaggatgaggaccggaagcgggctgcccaggtcgcaatgatcgccaacttcgtgggcttccgcatgtacaagatgctgaatgaggcaggaagtggggccagtggggccatcctctcaccaccagctctctttggcaccctggtctctttctaccttggatccttagatcccacggccagccagctgcagacgctgctggatgtccctgtgaaggagggagactgcacctcccgactagatggacacaaggtcctcgctgccctgcgggccattcagggcttgctggtcacccagggtgggagcagcagccagacacccctgctacagtccattgtggtggggctcttcactgctccaggctttcgtctaaagcactcatttgttcagagcctggctctctttacccctgccctcttcccacgctctctggatttatccactgacccagttcttgccactgagaaaatcaacaggttcataaaggctgtgacagggtggaagatgaacttgccactggagggggtcagtacagacagcaccctacttttcaacacctacgttcacttccaaggaacgatgagaggtttctctcagctgcctggagtccatgaattctgggtggacaacagcatctcggtgtctgtgcccatgatctccggcactggcaacttccagcactggagtgacacccagaacaacttctccgtgacgtgcgtgcccctaggtgagagagccaccctgctgctcatccagccccactgcacctcagatctcgacagggtggaggccctcatcttccggaacgacctcctgacttggatagagaacccgcctcctcgggccatccgcctgactctgccccagctggaaatccgaggatcctacaatctgcaggacctgctggctgaggacaagctgcccacccttttgggtgcggaggcaaatctgaacaacattggtgacaccaacccccgagtgggagaggttctcaatagcatcctcctcgaactcaaagcaggagaggaggaacagccgaccacgtctgtccagcagcctggctcaccggaggcactggatgtgaccctgagcagccccttcctgttcgccatctacgagcaggactcaggcacgctgcactttctgggcagagtgaataacccccagagtgtggtgtga

SEQ ID NO: 521 - RNA, 1458 nt, Macaca fascicularis
  source 1..1458: mol_type = mRNA
atgcagaagcgagcaccccagtccgagatggctcctgccagcgtgagcctgagggccaccatcctctgcctcctggcctgggctggcctggccacaggtgaccgggtgtacatacaccccttccacctcgtcatccacaatgagagtacctgtgagcagctggcaaaggccgatgctgggaagcccaaagatcccaccttcacacctgttccgatacaggccaagacgtctcctgtggatgaaaaggccctgcaggaccagctagtgctggttgccgcaaaactcgacaccgaggacaagttgagagccgcgatggtcgggatgctggccaacttcttgggcttccgtatatatggcatgcacagtgagctatggggcgtggtccatggggccaccatcctctccccaacggctgtctttggcaccctggcctctctctacctgggagcgttggaccacacagccgacaggctacaggcaatcctgggcgtcccttggaaggacaagaactgcacctcccggctggatgcgcacaaggtcctctctgccctgcaggctgtacagggcctgctggtggcccagggcagggctgacggccagtcccagctgctgttgtccacagtggtgggtctcttcacagccccagatctgcacctgaagcagccgtttgtgcagggcctggctctctatgcccctgtggtcctcccacgctctctggacttcacagacctggaagtcgctgctgagaagattgacaggttcatgcaggctgtgacaggatggaagattagcagccccctgacgggagccagtgcggacagcaccctggttttcaacacctacgtccatttccaagggaagatgagggacttcttcctgctggctgagccccaggagttctgggtggacaacagcacctcagtgtctgtccccatgctgtctggcgtgggcaccttccagcactggagcgacgcccaggacaacttctcagtgactcaagtgccctttactgagagcgcctgcttgctgctgattcagcctcactacgcctctgacctggacaaggtggagggtctcactttccagcaaaactccctcaactggatgaagaaactgtctccccgggccatccacctgaccatgccccgactggtgctgcgaggatcttatgacctgcaggacctgcttgcccaggctgagctgcccgccattctgggcaccgagctgaacctgcaaaaattgagcaatgacaacctcagggtggggaaggtgctgaacagcattctttttgaactcgaagcggatgagagagagcccacagagtctacccgacagctgaacaggcctgagttcttggaggtgaccctggaccgcccattcctgtttgctgtgtatgatcaaagtgccactgccctgcacttcctgggccgtgtggccaacccgctgagcccagcatga

SEQ ID NO: 522 - RNA, 21 nt, synthetic construct
  source 1..21: mol_type = other RNA
caccagcttgtttgtgaaaca

SEQ ID NO: 523 - RNA, 21 nt, synthetic construct
  source 1..21: mol_type = other RNA
tgtttcacaaacaagctggtg

SEQ ID NO: 524 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide attached to ((2S,4R)-1-(1-(((2R,3R,4R,5R,6R)-3-acetamido-4,5-dihydroxy- 6-(hydroxymethyl)tetrahydro-2H-pyran-2-yl)oxy)-16,16-bis((3 -((3-(5-(((2R,3R,4R,5R,6R)-3-acetamido-4,5-dihydroxy-6-(hyd roxymethyl)tetrahydro-2H-pyran-2-yl)oxy)pentanamido)propyl) amino)-3-oxopropoxy)methyl)-5,11,18-trioxo-14-oxa-6,10,17-t riazanonacosan-29-oyl)-4-hydroxypyrrolidin-2-yl)methyl methyl hydrogen phosphate
ccaaccgaccagcttgtttga

SEQ ID NO: 525 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcaaacaagctggtcggttgg

SEQ ID NO: 526 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(1-(((2R,3R,4R,5R,6R)-3-acetamido-4,5-dihydroxy-6-(hyd roxymethyl)tetrahydro-2H-pyran-2-yl)oxy)-9,13-bis(2-((2-(2- (((2R,3R,4R,5R,6R)-3-acetamido-4,5-dihydroxy-6-(hydroxymeth yl)tetrahydro-2H-pyran-2-yl)oxy)ethoxy)ethyl)amino)-2-oxoet hyl)-7,14-dioxo-3-oxa-6,9,13-triazaoctadecan-18-oyl)piperid in-4-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
caccagcttgtttgtgaaaca

SEQ ID NO: 527 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtg

SEQ ID NO: 528 - RNA, 21 nt, synthetic construct
  source 1..21: mol_type = other RNA
caccagcttgtttgtgaaaca

SEQ ID NO: 529 - RNA, 21 nt, synthetic construct
  source 1..21: mol_type = other RNA
caccagcttgtttgtgaaact

SEQ ID NO: 530 - RNA, 21 nt, synthetic construct
  source 1..21: mol_type = other RNA
caccagcttgtttgtgaaacc

SEQ ID NO: 531 - RNA, 21 nt, synthetic construct
  source 1..21: mol_type = other RNA
caccagcttgtttgtgaaacg

SEQ ID NO: 532 - RNA, 17 nt, synthetic construct
  source 1..17: mol_type = other RNA
agcttgtttgtgaaaca

SEQ ID NO: 533 - RNA, 18 nt, synthetic construct
  source 1..18: mol_type = other RNA
cagcttgtttgtgaaaca

SEQ ID NO: 534 - RNA, 19 nt, synthetic construct
  source 1..19: mol_type = other RNA
acagcttgtttgtgaaaca

SEQ ID NO: 535 - RNA, 19 nt, synthetic construct
  source 1..19: mol_type = other RNA
tcagcttgtttgtgaaaca

SEQ ID NO: 536 - RNA, 19 nt, synthetic construct
  source 1..19: mol_type = other RNA
gcagcttgtttgtgaaaca

SEQ ID NO: 537 - RNA, 19 nt, synthetic construct
  source 1..19: mol_type = other RNA
ccagcttgtttgtgaaaca

SEQ ID NO: 538 - RNA, 20 nt, synthetic construct
  source 1..20: mol_type = other RNA
accagcttgtttgtgaaaca

SEQ ID NO: 539 - RNA, 20 nt, synthetic construct
  source 1..20: mol_type = other RNA
tccagcttgtttgtgaaaca

SEQ ID NO: 540 - RNA, 20 nt, synthetic construct
  source 1..20: mol_type = other RNA
gccagcttgtttgtgaaaca

SEQ ID NO: 541 - RNA, 20 nt, synthetic construct
  source 1..20: mol_type = other RNA
cccagcttgtttgtgaaaca

SEQ ID NO: 542 - RNA, 21 nt, synthetic construct
  source 1..21: mol_type = other RNA
gaccagcttgtttgtgaaaca

SEQ ID NO: 543 - RNA, 21 nt, synthetic construct
  source 1..21: mol_type = other RNA
aaccagcttgtttgtgaaaca

SEQ ID NO: 544 - RNA, 21 nt, synthetic construct
  source 1..21: mol_type = other RNA
taccagcttgtttgtgaaaca

SEQ ID NO: 545 - RNA, 22 nt, synthetic construct
  source 1..22: mol_type = other RNA
cgaccagcttgtttgtgaaaca

SEQ ID NO: 546 - RNA, 23 nt, synthetic construct
  source 1..23: mol_type = other RNA
ccgaccagcttgtttgtgaaaca

SEQ ID NO: 547 - RNA, 24 nt, synthetic construct
  source 1..24: mol_type = other RNA
accgaccagcttgtttgtgaaaca

SEQ ID NO: 548 - RNA, 25 nt, synthetic construct
  source 1..25: mol_type = other RNA
aaccgaccagcttgtttgtgaaaca

SEQ ID NO: 549 - RNA, 26 nt, synthetic construct
  source 1..26: mol_type = other RNA
caaccgaccagcttgtttgtgaaaca

SEQ ID NO: 550 - RNA, 32 nt, synthetic construct
  source 1..32: mol_type = other RNA
gaattccaaccgaccagcttgtttgtgaaaca

SEQ ID NO: 551 - RNA, 21 nt, synthetic construct
  source 1..21: mol_type = other RNA
caccagcttgtttgtgaaaca

SEQ ID NO: 552 - RNA, 21 nt, synthetic construct
  source 1..21: mol_type = other RNA
caccagcttgtttgtgaaaca

SEQ ID NO: 553 - RNA, 21 nt, synthetic construct
  source 1..21: mol_type = other RNA
caccagcttgtttgtgaaaca

SEQ ID NO: 554 - RNA, 21 nt, synthetic construct
  source 1..21: mol_type = other RNA
caccagcttgtttgtgaaaca

SEQ ID NO: 555 - RNA, 21 nt, synthetic construct
  source 1..21: mol_type = other RNA
caccagcttgtttgtgaaaca

SEQ ID NO: 556 - RNA, 21 nt, synthetic construct
  source 1..21: mol_type = other RNA
caccagcttgtttgtaaaaca

SEQ ID NO: 557 - RNA, 21 nt, synthetic construct
  source 1..21: mol_type = other RNA
caccagcttgtttgtgaaata

SEQ ID NO: 558 - RNA, 21 nt, synthetic construct
  source 1..21: mol_type = other RNA
caccagcttgtttgtgaaaca

SEQ ID NO: 559 - RNA, 21 nt, synthetic construct
  source 1..21: mol_type = other RNA
tgtttcacaaacaagctggtg

SEQ ID NO: 560 - RNA, 21 nt, synthetic construct
  source 1..21: mol_type = other RNA
agtttcacaaacaagctggtg

SEQ ID NO: 561 - RNA, 21 nt, synthetic construct
  source 1..21: mol_type = other RNA
ggtttcacaaacaagctggtg

SEQ ID NO: 562 - RNA, 21 nt, synthetic construct
  source 1..21: mol_type = other RNA
cgtttcacaaacaagctggtg

SEQ ID NO: 563 - RNA, 17 nt, synthetic construct
  source 1..17: mol_type = other RNA
tgtttcacaaacaagct

SEQ ID NO: 564 - RNA, 18 nt, synthetic construct
  source 1..18: mol_type = other RNA
tgtttcacaaacaagctg

SEQ ID NO: 565 - RNA, 19 nt, synthetic construct
  source 1..19: mol_type = other RNA
tgtttcacaaacaagctgt

SEQ ID NO: 566 - RNA, 19 nt, synthetic construct
  source 1..19: mol_type = other RNA
tgtttcacaaacaagctga

SEQ ID NO: 567 - RNA, 19 nt, synthetic construct
  source 1..19: mol_type = other RNA
tgtttcacaaacaagctgc

SEQ ID NO: 568 - RNA, 19 nt, synthetic construct
  source 1..19: mol_type = other RNA
tgtttcacaaacaagctgg

SEQ ID NO: 569 - RNA, 20 nt, synthetic construct
  source 1..20: mol_type = other RNA
tgtttcacaaacaagctggt

SEQ ID NO: 570 - RNA, 20 nt, synthetic construct
  source 1..20: mol_type = other RNA
tgtttcacaaacaagctgga

SEQ ID NO: 571 - RNA, 20 nt, synthetic construct
  source 1..20: mol_type = other RNA
tgtttcacaaacaagctggc

SEQ ID NO: 572 - RNA, 20 nt, synthetic construct
  source 1..20: mol_type = other RNA
tgtttcacaaacaagctggg

SEQ ID NO: 573 - RNA, 21 nt, synthetic construct
  source 1..21: mol_type = other RNA
tgtttcacaaacaagctggtc

SEQ ID NO: 574 - RNA, 21 nt, synthetic construct
  source 1..21: mol_type = other RNA
tgtttcacaaacaagctggtt

SEQ ID NO: 575 - RNA, 21 nt, synthetic construct
  source 1..21: mol_type = other RNA
tgtttcacaaacaagctggta

SEQ ID NO: 576 - RNA, 22 nt, synthetic construct
  source 1..22: mol_type = other RNA
tgtttcacaaacaagctggtcg

SEQ ID NO: 577 - RNA, 23 nt, synthetic construct
  source 1..23: mol_type = other RNA
tgtttcacaaacaagctggtcgg

SEQ ID NO: 578 - RNA, 24 nt, synthetic construct
  source 1..24: mol_type = other RNA
tgtttcacaaacaagctggtcggt

SEQ ID NO: 579 - RNA, 25 nt, synthetic construct
  source 1..25: mol_type = other RNA
tgtttcacaaacaagctggtcggtt

SEQ ID NO: 580 - RNA, 26 nt, synthetic construct
  source 1..26: mol_type = other RNA
tgtttcacaaacaagctggtcggttg

SEQ ID NO: 581 - RNA, 32 nt, synthetic construct
  source 1..32: mol_type = other RNA
tgtttcacaaacaagctggtcggttggaattc

SEQ ID NO: 582 - RNA, 23 nt, synthetic construct
  source 1..23: mol_type = other RNA
tgtttcacaaacaagctggtgtt

SEQ ID NO: 583 - RNA, 23 nt, synthetic construct
  source 1..23: mol_type = other RNA
tgtttcacaaacaagctggtgga

SEQ ID NO: 584 - RNA, 21 nt, synthetic construct
  source 1..21: mol_type = other RNA
tgtttcacaaacaagctggtg

SEQ ID NO: 585 - RNA, 21 nt, synthetic construct
  source 1..21: mol_type = other RNA
tgtttcacaaacaagctggtg

SEQ ID NO: 586 - RNA, 21 nt, synthetic construct
  source 1..21: mol_type = other RNA
tgtttcacaaacaagctggtg

SEQ ID NO: 587 - RNA, 21 nt, synthetic construct
  source 1..21: mol_type = other RNA
tgtttcacaaacaagctggtg

SEQ ID NO: 588 - RNA, 21 nt, synthetic construct
  source 1..21: mol_type = other RNA
tatttcacaaacaagctggtg

SEQ ID NO: 589 - RNA, 21 nt, synthetic construct
  source 1..21: mol_type = other RNA
tgtttcacaaacaagctggtg

SEQ ID NO: 590 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
caccagcttgtttgtgaaaca

SEQ ID NO: 591 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
caccagcttgtttgtgaaact

SEQ ID NO: 592 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
caccagcttgtttgtgaaacc

SEQ ID NO: 593 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
caccagcttgtttgtgaaacg

SEQ ID NO: 594 - RNA, 17 nt, synthetic construct
  source 1..17: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-fluoro modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide with thiophosphate linkage
  modified_base 17: mod_base = OTHER; note = 2'-O-methyl modified nucleotide
agcttgtttgtgaaaca

SEQ ID NO: 595 - RNA, 18 nt, synthetic construct
  source 1..18: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-fluoro modified nucleotide
  modified_base 7: mod_base = OTHER; note = 2'-O-methyl modified nucleotide
  modified_base 8: mod_base = OTHER; note = 2'-fluoro modified nucleotide
  modified_base 9: mod_base = OTHER; note = 2'-O-methyl modified nucleotide
  modified_base 10: mod_base = OTHER; note = 2'-fluoro modified nucleotide
  modified_base 11: mod_base = OTHER; note = 2'-O-methyl modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide
cagcttgtttgtgaaaca

SEQ ID NO: 596 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide with thiophosphate linkage
  modified_base 19: mod_base = OTHER; note = 2'-O-methyl modified nucleotide
acagcttgtttgtgaaaca

SEQ ID NO: 597 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide with thiophosphate linkage
  modified_base 19: mod_base = OTHER; note = 2'-O-methyl modified nucleotide
tcagcttgtttgtgaaaca

SEQ ID NO: 598 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide with thiophosphate linkage
  modified_base 19: mod_base = OTHER; note = 2'-O-methyl modified nucleotide
gcagcttgtttgtgaaaca

SEQ ID NO: 599 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide with thiophosphate linkage
  modified_base 19: mod_base = OTHER; note = 2'-O-methyl modified nucleotide
ccagcttgtttgtgaaaca

SEQ ID NO: 600 - RNA, 20 nt, synthetic construct
  source 1..20: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-fluoro modified nucleotide
  modified_base 9: mod_base = OTHER; note = 2'-O-methyl modified nucleotide
  modified_base 10: mod_base = OTHER; note = 2'-fluoro modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide
accagcttgtttgtgaaaca

SEQ ID NO: 601 - RNA, 20 nt, synthetic construct
  source 1..20: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-fluoro modified nucleotide
  modified_base 9: mod_base = OTHER; note = 2'-O-methyl modified nucleotide
  modified_base 10: mod_base = OTHER; note = 2'-fluoro modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide
tccagcttgtttgtgaaaca

SEQ ID NO: 602 - RNA, 20 nt, synthetic construct
  source 1..20: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-fluoro modified nucleotide
  modified_base 9: mod_base = OTHER; note = 2'-O-methyl modified nucleotide
  modified_base 10: mod_base = OTHER; note = 2'-fluoro modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide
gccagcttgtttgtgaaaca

SEQ ID NO: 603 - RNA, 20 nt, synthetic construct
  source 1..20: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-fluoro modified nucleotide
  modified_base 9: mod_base = OTHER; note = 2'-O-methyl modified nucleotide
  modified_base 10: mod_base = OTHER; note = 2'-fluoro modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide
cccagcttgtttgtgaaaca

SEQ ID NO: 604 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
gaccagcttgtttgtgaaaca

SEQ ID NO: 605 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
aaccagcttgtttgtgaaaca

SEQ ID NO: 606 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
taccagcttgtttgtgaaaca

SEQ ID NO: 607 - RNA, 22 nt, synthetic construct
  source 1..22: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-fluoro modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide with thiophosphate linkage
  modified_base 22: mod_base = OTHER; note = 2'-O-methyl modified nucleotide
cgaccagcttgtttgtgaaaca

SEQ ID NO: 608 - RNA, 23 nt, synthetic construct
  source 1..23: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-fluoro modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide
  modified_base 22: mod_base = OTHER; note = 2'-O-methyl modified nucleotide with thiophosphate linkage
  modified_base 23: mod_base = OTHER; note = 2'-O-methyl modified nucleotide
ccgaccagcttgtttgtgaaaca

SEQ ID NO: 609 - RNA, 24 nt, synthetic construct
  source 1..24: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide
  modified_base 22: mod_base = OTHER; note = 2'-O-methyl modified nucleotide
  modified_base 23: mod_base = OTHER; note = 2'-O-methyl modified nucleotide with thiophosphate linkage
  modified_base 24: mod_base = OTHER; note = 2'-O-methyl modified nucleotide
accgaccagcttgtttgtgaaaca

SEQ ID NO: 610 - RNA, 25 nt, synthetic construct
  source 1..25: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-fluoro modified nucleotide
  modified_base 16: mod_base = OTHER; note = 2'-O-methyl modified nucleotide
  modified_base 17: mod_base = OTHER; note = 2'-fluoro modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide
  modified_base 22: mod_base = OTHER; note = 2'-O-methyl modified nucleotide
  modified_base 23: mod_base = OTHER; note = 2'-O-methyl modified nucleotide
  modified_base 24: mod_base = OTHER; note = 2'-O-methyl modified nucleotide with thiophosphate linkage
  modified_base 25: mod_base = OTHER; note = 2'-O-methyl modified nucleotide
aaccgaccagcttgtttgtgaaaca

SEQ ID NO: 611 - RNA, 26 nt, synthetic construct
  source 1..26: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-fluoro modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide
  modified_base 22: mod_base = OTHER; note = 2'-O-methyl modified nucleotide
  modified_base 23: mod_base = OTHER; note = 2'-O-methyl modified nucleotide
  modified_base 24: mod_base = OTHER; note = 2'-O-methyl modified nucleotide
  modified_base 25: mod_base = OTHER; note = 2'-O-methyl modified nucleotide with thiophosphate linkage
  modified_base 26: mod_base = OTHER; note = 2'-O-methyl modified nucleotide
caaccgaccagcttgtttgtgaaaca

SEQ ID NO: 612 - RNA, 32 nt, synthetic construct; identical to SEQ ID NO: 550
  source 1..32: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-fluoro modified nucleotide
  modified_base 21: mod_base = OTHER; note = 2'-O-methyl modified nucleotide
  modified_base 22: mod_base = OTHER; note = 2'-fluoro modified nucleotide
  modified_base 23: mod_base = OTHER; note = 2'-O-methyl modified nucleotide
  modified_base 24: mod_base = OTHER; note = 2'-fluoro modified nucleotide
  modified_base 25: mod_base = OTHER; note = 2'-O-methyl modified nucleotide
  modified_base 26: mod_base = OTHER; note = 2'-O-methyl modified nucleotide
  modified_base 27: mod_base = OTHER; note = 2'-O-methyl modified nucleotide
  modified_base 28: mod_base = OTHER; note = 2'-O-methyl modified nucleotide
  modified_base 29: mod_base = OTHER; note = 2'-O-methyl modified nucleotide
  modified_base 30: mod_base = OTHER; note = 2'-O-methyl modified nucleotide
  modified_base 31: mod_base = OTHER; note = 2'-O-methyl modified nucleotide with thiophosphate linkage
  modified_base 32: mod_base = OTHER; note = 2'-O-methyl modified nucleotide

SEQ ID NO: 613 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
caccagcttgtttgtgaaaca

SEQ ID NO: 614 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
caccagcttgtttgtgaaaca

SEQ ID NO: 615 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
caccagcttgtttgtgaaaca

SEQ ID NO: 616 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
caccagcttgtttgtgaaaca

SEQ ID NO: 617 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-fluoro modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
caccagcttgtttgtgaaaca

SEQ ID NO: 618 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
caccagcttgtttgtaaaaca

SEQ ID NO: 619 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide
caccagcttgtttgtgaaata

SEQ ID NO: 620 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-O-methyl modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
caccagcttgtttgtgaaaca

SEQ ID NO: 621 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtg

SEQ ID NO: 622 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
agtttcacaaacaagctggtg

SEQ ID NO: 623 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
ggtttcacaaacaagctggtg

SEQ ID NO: 624 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
cgtttcacaaacaagctggtg

SEQ ID NO: 625 - RNA, 17 nt, synthetic construct
  source 1..17: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide with thiophosphate linkage
  modified_base 16: mod_base = OTHER; note = 2'-fluoro modified nucleotide with thiophosphate linkage
  modified_base 17: mod_base = OTHER; note = 2'-O-methyl modified nucleotide
tgtttcacaaacaagct

SEQ ID NO: 626 - RNA, 18 nt, synthetic construct
  source 1..18: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide with thiophosphate linkage
  modified_base 17: mod_base = OTHER; note = 2'-O-methyl modified nucleotide with thiophosphate linkage
  modified_base 18: mod_base = OTHER; note = 2'-O-methyl modified nucleotide
tgtttcacaaacaagctg

SEQ ID NO: 627 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
tgtttcacaaacaagctgt

SEQ ID NO: 628 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
tgtttcacaaacaagctga

SEQ ID NO: 629 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
tgtttcacaaacaagctgc

SEQ ID NO: 630 - RNA, 19 nt, synthetic construct
  source 1..19: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide with thiophosphate linkage
  modified_base 18: mod_base = OTHER; note = 2'-O-methyl modified nucleotide with thiophosphate linkage
  modified_base 19: mod_base = OTHER; note = 2'-O-methyl modified nucleotide
tgtttcacaaacaagctgg

SEQ ID NO: 631 - RNA, 20 nt, synthetic construct
  source 1..20: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide with thiophosphate linkage
  modified_base 19: mod_base = OTHER; note = 2'-O-methyl modified nucleotide with thiophosphate linkage
  modified_base 20: mod_base = OTHER; note = 2'-O-methyl modified nucleotide
tgtttcacaaacaagctggt

SEQ ID NO: 632 - RNA, 20 nt, synthetic construct
  source 1..20: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide with thiophosphate linkage
  modified_base 19: mod_base = OTHER; note = 2'-O-methyl modified nucleotide with thiophosphate linkage
  modified_base 20: mod_base = OTHER; note = 2'-O-methyl modified nucleotide
tgtttcacaaacaagctgga

SEQ ID NO: 633 - RNA, 20 nt, synthetic construct
  source 1..20: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide with thiophosphate linkage
  modified_base 19: mod_base = OTHER; note = 2'-O-methyl modified nucleotide with thiophosphate linkage
  modified_base 20: mod_base = OTHER; note = 2'-O-methyl modified nucleotide
tgtttcacaaacaagctggc

SEQ ID NO: 634 - RNA, 20 nt, synthetic construct
  source 1..20: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide with thiophosphate linkage
  modified_base 19: mod_base = OTHER; note = 2'-O-methyl modified nucleotide with thiophosphate linkage
  modified_base 20: mod_base = OTHER; note = 2'-O-methyl modified nucleotide
tgtttcacaaacaagctggg

SEQ ID NO: 635 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtc

SEQ ID NO: 636 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtt

SEQ ID NO: 637 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggta

SEQ ID NO: 638 - RNA, 22 nt, synthetic construct
  source 1..22: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide with thiophosphate linkage
  modified_base 21: mod_base = OTHER; note = 2'-O-methyl modified nucleotide with thiophosphate linkage
  modified_base 22: mod_base = OTHER; note = 2'-O-methyl modified nucleotide
tgtttcacaaacaagctggtcg

SEQ ID NO: 639 - RNA, 23 nt, synthetic construct
  source 1..23: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide with thiophosphate linkage
  modified_base 22: mod_base = OTHER; note = 2'-O-methyl modified nucleotide with thiophosphate linkage
  modified_base 23: mod_base = OTHER; note = 2'-O-methyl modified nucleotide
tgtttcacaaacaagctggtcgg

SEQ ID NO: 640 - RNA, 24 nt, synthetic construct
  source 1..24: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide
  modified_base 22: mod_base = OTHER; note = 2'-O-methyl modified nucleotide with thiophosphate linkage
  modified_base 23: mod_base = OTHER; note = 2'-O-methyl modified nucleotide with thiophosphate linkage
  modified_base 24: mod_base = OTHER; note = 2'-O-methyl modified nucleotide
tgtttcacaaacaagctggtcggt

SEQ ID NO: 641 - RNA, 25 nt, synthetic construct
  source 1..25: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide
  modified_base 22: mod_base = OTHER; note = 2'-O-methyl modified nucleotide
  modified_base 23: mod_base = OTHER; note = 2'-O-methyl modified nucleotide with thiophosphate linkage
  modified_base 24: mod_base = OTHER; note = 2'-O-methyl modified nucleotide with thiophosphate linkage
  modified_base 25: mod_base = OTHER; note = 2'-O-methyl modified nucleotide
tgtttcacaaacaagctggtcggtt

SEQ ID NO: 642 - RNA, 26 nt, synthetic construct
  source 1..26: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide
  modified_base 22: mod_base = OTHER; note = 2'-O-methyl modified nucleotide
  modified_base 23: mod_base = OTHER; note = 2'-O-methyl modified nucleotide
  modified_base 24: mod_base = OTHER; note = 2'-O-methyl modified nucleotide with thiophosphate linkage
  modified_base 25: mod_base = OTHER; note = 2'-O-methyl modified nucleotide with thiophosphate linkage
  modified_base 26: mod_base = OTHER; note = 2'-O-methyl modified nucleotide
tgtttcacaaacaagctggtcggttg

SEQ ID NO: 643 - RNA, 32 nt, synthetic construct; identical to SEQ ID NO: 581
  source 1..32: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide
  modified_base 22: mod_base = OTHER; note = 2'-O-methyl modified nucleotide
  modified_base 23: mod_base = OTHER; note = 2'-O-methyl modified nucleotide
  modified_base 24: mod_base = OTHER; note = 2'-O-methyl modified nucleotide
  modified_base 25: mod_base = OTHER; note = 2'-O-methyl modified nucleotide
  modified_base 26: mod_base = OTHER; note = 2'-O-methyl modified nucleotide
  modified_base 27: mod_base = OTHER; note = 2'-O-methyl modified nucleotide
  modified_base 28: mod_base = OTHER; note = 2'-O-methyl modified nucleotide
  modified_base 29: mod_base = OTHER; note = 2'-O-methyl modified nucleotide
  modified_base 30: mod_base = OTHER; note = 2'-O-methyl modified nucleotide with thiophosphate linkage
  modified_base 31: mod_base = OTHER; note = 2'-O-methyl modified nucleotide with thiophosphate linkage
  modified_base 32: mod_base = OTHER; note = 2'-O-methyl modified nucleotide

SEQ ID NO: 644 - RNA, 23 nt, synthetic construct
  source 1..23: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide with thiophosphate linkage
  modified_base 22: mod_base = OTHER; note = 2'-O-methyl modified nucleotide with thiophosphate linkage
  modified_base 23: mod_base = OTHER; note = 2'-O-methyl modified nucleotide
tgtttcacaaacaagctggtgtt

SEQ ID NO: 645 - RNA, 23 nt, synthetic construct
  source 1..23: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide with thiophosphate linkage
  modified_base 22: mod_base = OTHER; note = 2'-O-methyl modified nucleotide with thiophosphate linkage
  modified_base 23: mod_base = OTHER; note = 2'-O-methyl modified nucleotide
tgtttcacaaacaagctggtgga

SEQ ID NO: 646 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = Unlocked nucleic acid
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtg

SEQ ID NO: 647 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = Unlocked nucleic acid
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtg

SEQ ID NO: 648 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-fluoro modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-O-methyl modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtg

SEQ ID NO: 649 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtg

SEQ ID NO: 650 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tatttcacaaacaagctggtg

SEQ ID NO: 651 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tgtttcacaaacaagctggtg

SEQ ID NO: 652 - RNA, 18 nt, synthetic construct
  source 1..18: mol_type = other RNA
ccagcttgtttgtgaaac

SEQ ID NO: 653 - RNA, 18 nt, synthetic construct
  source 1..18: mol_type = other RNA
gtttcacaaacaagctgg

SEQ ID NO: 654 - RNA, 21 nt, synthetic construct
  source 1..21: mol_type = other RNA
  modified_base 1: mod_base = OTHER; note = 2'-O-methyl modified nucleotide attached to 5'-5' thiophosphate inverted abasic site which is attached to O-(1-(1-(((2R,3R,4R,5R,6R)-3-acetamido-4,5-dihydroxy-6-(hyd roxymethyl)tetrahydro-2H-pyran-2-yl)oxy)-9,13-bis(2-((2-(2- (((2R,3R,4R,5R,6R)-3-acetamido-4,5-dihydroxy-6-(hydroxymeth yl)tetrahydro-2H-pyran-2-yl)oxy)ethoxy)ethyl)amino)-2-oxoet hyl)-7,14-dioxo-3-oxa-6,9,13-triazaoctadecan-18-oyl)piperid in-4-yl) O-methyl phosphorothioate via a thiophosphate linkage
  modified_base 2: mod_base = OTHER; note = 2'-O-methyl modified nucleotide
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-O-methyl modified nucleotide
  modified_base 8: mod_base = OTHER; note = 2'-O-methyl modified nucleotide
  modified_base 9: mod_base = OTHER; note = 2'-fluoro modified nucleotide
  modified_base 10: mod_base = OTHER; note = 2'-O-methyl modified nucleotide
  modified_base 11: mod_base = OTHER; note = 2'-fluoro modified nucleotide
  modified_base 12: mod_base = OTHER; note = 2'-O-methyl modified nucleotide
  modified_base 13: mod_base = OTHER; note = 2'-fluoro modified nucleotide
  modified_base 14: mod_base = OTHER; note = 2'-O-methyl modified nucleotide
  modified_base 15: mod_base = OTHER; note = 2'-O-methyl modified nucleotide
  modified_base 16: mod_base = OTHER; note = 2'-O-methyl modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide
  modified_base 20: mod_base = OTHER; note = 2'-O-methyl modified nucleotide
  modified_base 21: mod_base = OTHER; note = 2'-O-methyl modified nucleotide attached to 3'-3' thiophosphate inverted abasic site
gcgtttctccttggtctaaga

SEQ ID NO: 655 - RNA, 21 nt, synthetic construct
  source 1..21: mol_type = other RNA
  modified_base 1: mod_base = OTHER; note = 2'-O-methyl modified nucleotide with thiophosphate linkage
  modified_base 2: mod_base = OTHER; note = 2'-fluoro modified nucleotide with thiophosphate linkage
  modified_base 3: mod_base = OTHER; note = 2'-O-methyl modified nucleotide
  modified_base 4: mod_base = OTHER; note = 2'-O-methyl modified nucleotide
  modified_base 5: mod_base = OTHER; note = 2'-O-methyl modified nucleotide
  modified_base 6: mod_base = OTHER; note = 2'-O-methyl modified nucleotide
  modified_base 7: mod_base = OTHER; note = 2'-fluoro modified nucleotide
  modified_base 8: mod_base = OTHER; note = 2'-O-methyl modified nucleotide
  modified_base 9: mod_base = OTHER; note = 2'-O-methyl modified nucleotide
  modified_base 10: mod_base = OTHER; note = 2'-O-methyl modified nucleotide
  modified_base 11: mod_base = OTHER; note = 2'-O-methyl modified nucleotide
  modified_base 12: mod_base = OTHER; note = 2'-fluoro modified nucleotide
  modified_base 13: mod_base = OTHER; note = 2'-O-methyl modified nucleotide
  modified_base 14: mod_base = OTHER; note = 2'-fluoro modified nucleotide
  modified_base 15: mod_base = OTHER; note = 2'-O-methyl modified nucleotide
  modified_base 16: mod_base = OTHER; note = 2'-fluoro modified nucleotide
  modified_base 17: mod_base = OTHER; note = 2'-O-methyl modified nucleotide
  modified_base 18: mod_base = OTHER; note = 2'-O-methyl modified nucleotide
  modified_base 19: mod_base = OTHER; note = 2'-O-methyl modified nucleotide with thiophosphate linkage
  modified_base 20: mod_base = OTHER; note = 2'-O-methyl modified nucleotide with thiophosphate linkage
  modified_base 21: mod_base = OTHER; note = 2'-O-methyl modified nucleotide
tcttagaccaaggagaaacgc

SEQ ID NO: 656 - RNA, 32 nt, synthetic construct
  source 1..32: mol_type = other RNA
  misc_difference 1: note = a, c, u, g, unknown or other
  misc_difference 2: note = a, c, u, g, unknown or other
  misc_difference 3: note = a, c, u, g, unknown or other
  misc_difference 4: note = a, c, u, g, unknown or other
  misc_difference 5: note = a, c, u, g, unknown or other
  misc_difference 6: note = a, c, u, g, unknown or other
  misc_difference 7: note = a, c, u, g, unknown or other
  misc_difference 8: note = a, c, u, g, unknown or other
  misc_difference 9: note = a, c, u, g, unknown or other
  misc_difference 10: note = a, c, u, g, unknown or other
  misc_difference 11: note = a, c, u, g, unknown or other
  misc_difference 12: note = a, c, u, g, unknown or other
  misc_difference 13: note = a, c, u, g, unknown or other
  misc_difference 14: note = a, c, u, g, unknown or other
  misc_difference 15: note = a, c, u, g, unknown or other
  misc_difference 32: note = a, c, u, g, or absent
  misc_difference 1..15: note = This region may encompass 0-15 nucleotides
nnnnnnnnnnnnnnnagcttgtttgtgaaacn

SEQ ID NO: 657 - RNA, 10 nt, synthetic construct
  source 1..10: mol_type = other RNA
ccaaccgacc

SEQ ID NO: 658 - RNA, 11 nt, synthetic construct
  source 1..11: mol_type = other RNA
tccaaccgacc

SEQ ID NO: 659 - RNA, 12 nt, synthetic construct
  source 1..12: mol_type = other RNA
ttccaaccgacc

SEQ ID NO: 660 - RNA, 13 nt, synthetic construct
  source 1..13: mol_type = other RNA
attccaaccgacc

SEQ ID NO: 661 - RNA, 14 nt, synthetic construct
  source 1..14: mol_type = other RNA
aattccaaccgacc

SEQ ID NO: 662 - RNA, 15 nt, synthetic construct
  source 1..15: mol_type = other RNA
gaattccaaccgacc

SEQ ID NO: 663 - RNA, 32 nt, synthetic construct
  source 1..32: mol_type = other RNA
  misc_difference 1: note = a, c, u, g, or absent
  misc_difference 18: note = a, c, u, g, unknown or other
  misc_difference 19: note = a, c, u, g, unknown or other
  misc_difference 20: note = a, c, u, g, unknown or other
  misc_difference 21: note = a, c, u, g, unknown or other
  misc_difference 22: note = a, c, u, g, unknown or other
  misc_difference 23: note = a, c, u, g, unknown or other
  misc_difference 24: note = a, c, u, g, unknown or other
  misc_difference 25: note = a, c, u, g, unknown or other
  misc_difference 26: note = a, c, u, g, unknown or other
  misc_difference 27: note = a, c, u, g, unknown or other
  misc_difference 28: note = a, c, u, g, unknown or other
  misc_difference 29: note = a, c, u, g, unknown or other
  misc_difference 30: note = a, c, u, g, unknown or other
  misc_difference 31: note = a, c, u, g, unknown or other
  misc_difference 32: note = a, c, u, g, unknown or other
  misc_difference 18..32: note = This region may encompass 0-15 nucleotides
ngtttcacaaacaagctnnnnnnnnnnnnnnn

SEQ ID NO: 664 - RNA, 10 nt, synthetic construct
  source 1..10: mol_type = other RNA
ggtcggttgg

SEQ ID NO: 665 - RNA, 11 nt, synthetic construct
  source 1..11: mol_type = other RNA
ggtcggttgga

SEQ ID NO: 666 - RNA, 12 nt, synthetic construct
  source 1..12: mol_type = other RNA
ggtcggttggaa

SEQ ID NO: 667 - RNA, 13 nt, synthetic construct
  source 1..13: mol_type = other RNA
ggtcggttggaat

SEQ ID NO: 668 - RNA, 14 nt, synthetic construct
  source 1..14: mol_type = other RNA
ggtcggttggaatt

SEQ ID NO: 669 - RNA, 15 nt, synthetic construct
  source 1..15: mol_type = other RNA
ggtcggttggaattc

SEQ ID NO: 670 - RNA, 31 nt, synthetic construct
  source 1..31: mol_type = other RNA
  misc_difference 1: note = a, c, u, g, unknown or other
  misc_difference 2: note = a, c, u, g, unknown or other
  misc_difference 3: note = a, c, u, g, unknown or other
  misc_difference 4: note = a, c, u, g, unknown or other
  misc_difference 5: note = a, c, u, g, unknown or other
  misc_difference 6: note = a, c, u, g, unknown or other
  misc_difference 7: note = a, c, u, g, unknown or other
  misc_difference 8: note = a, c, u, g, unknown or other
  misc_difference 9: note = a, c, u, g, unknown or other
  misc_difference 10: note = a, c, u, g, unknown or other
  misc_difference 11: note = a, c, u, g, unknown or other
  misc_difference 12: note = a, c, u, g, unknown or other
  misc_difference 13: note = a, c, u, g, unknown or other
  misc_difference 1..13: note = This region may encompass 0-13 nucleotides
nnnnnnnnnnnnncagcttgtttgtgaaaca

SEQ ID NO: 671 - RNA, 31 nt, synthetic construct
  source 1..31: mol_type = other RNA
  misc_difference 19: note = a, c, u, g, unknown or other
  misc_difference 20: note = a, c, u, g, unknown or other
  misc_difference 21: note = a, c, u, g, unknown or other
  misc_difference 22: note = a, c, u, g, unknown or other
  misc_difference 23: note = a, c, u, g, unknown or other
  misc_difference 24: note = a, c, u, g, unknown or other
  misc_difference 25: note = a, c, u, g, unknown or other
  misc_difference 26: note = a, c, u, g, unknown or other
  misc_difference 27: note = a, c, u, g, unknown or other
  misc_difference 28: note = a, c, u, g, unknown or other
  misc_difference 29: note = a, c, u, g, unknown or other
  misc_difference 30: note = a, c, u, g, unknown or other
  misc_difference 31: note = a, c, u, g, unknown or other
  misc_difference 19..31: note = This region may encompass 0-13 nucleotides
tgtttcacaaacaagctgnnnnnnnnnnnnn

SEQ ID NO: 672 - RNA, 14 nt, synthetic construct
  source 1..14: mol_type = other RNA
gaattccaaccgac

SEQ ID NO: 673 - RNA, 14 nt, synthetic construct
  source 1..14: mol_type = other RNA
gtcggttggaattc

The invention claimed is:

1. A double-stranded RNA (dsRNA) agent for inhibiting angiotensinogen (AGT) gene expression, wherein the dsRNA agent comprises a sense strand and an antisense strand, wherein the sense strand comprises SEQ ID NO:526 ((GLS-15)*(Invab)*caccagcuUgUuUgugaaaca*(Invab)), wherein the antisense strand comprises SEQ ID NO:527 (u*G*uuucAcaaaCaAgCugg*u*g), and wherein each nucleotide in lower case has a 2'-O-methyl (2'-OMe) modification, each nucleotide in upper case has a 2'-fluoro modification, each star (*) is a phosphorothioate linkage, each Invab is an inverted abasic residue, and GLS-15 is

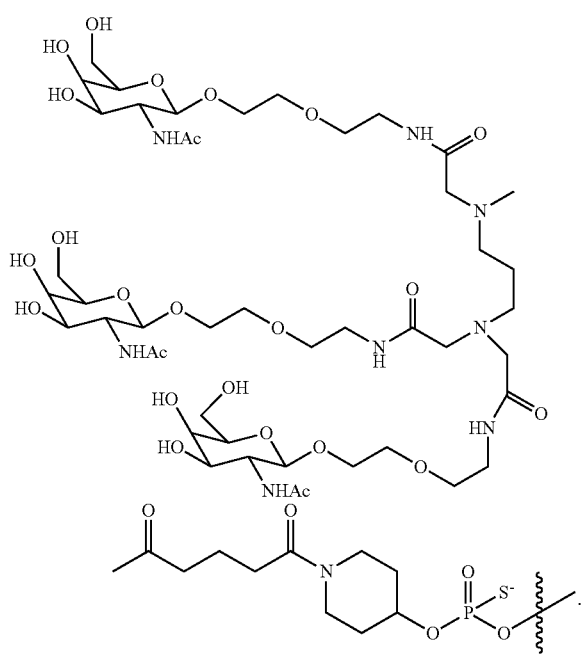

2. A composition comprising the dsRNA agent of claim 1 and a pharmaceutically acceptable carrier.

3. The composition of claim 2, wherein the composition is packaged in a kit, container, pack, dispenser, prefilled syringe, or vial.

4. The composition of claim 2, wherein the composition is formulated for subcutaneous administration.

5. The composition of claim 2, wherein the pharmaceutically acceptable carrier comprises a sodium salt.

6. A double-stranded RNA (dsRNA) agent for inhibiting angiotensinogen (AGT) gene expression, wherein the dsRNA agent comprises a sense strand and an antisense strand, wherein the sense strand consists of SEQ ID NO:526 ((GLS-15)*(Invab)*caccagcuUgUuUgugaaaca*(Invab)), wherein the antisense strand consists of SEQ ID NO:527 (u*G*uuucAcaaaCaAgCugg*u*g), and wherein each nucleotide in lower case has a 2'-O-methyl (2'-OMe) modification, each nucleotide in upper case has a 2'-fluoro modification, each star (*) is a phosphorothioate linkage, each Invab is an inverted abasic residue, and GLS-15 is

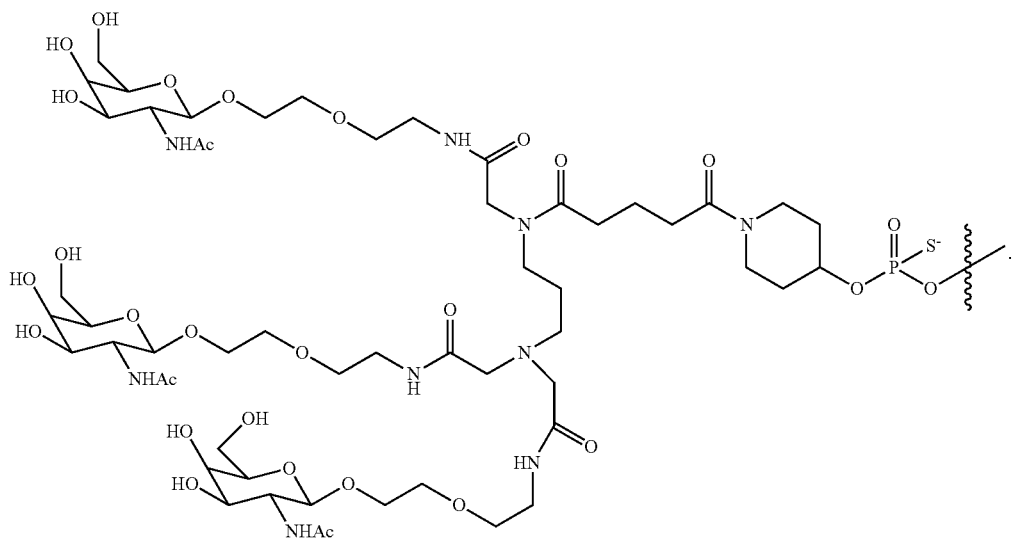 [SMILES: *OP(=O)([S-])OC1CCN(C(=O)CCCC(=O)N(CCCN(CC(=O)NCCOCCOC2OC(CO)C(O)C(O)C2NC(C)=O)CC(=O)NCCOCCOC2OC(CO)C(O)C(O)C2NC(C)=O)CC(=O)NCCOCCOC2OC(CO)C(O)C(O)C2NC(C)=O)CC1]

7. A composition comprising the dsRNA agent of claim 6 and a pharmaceutically acceptable carrier.

8. The composition of claim 7, wherein the pharmaceutically acceptable carrier comprises a sodium salt.

9. The composition of claim 7, wherein the composition is packaged in a kit, container, pack, dispenser, prefilled syringe, or vial.

10. The composition of claim 7, wherein the composition is formulated for subcutaneous administration.

\* \* \* \* \*